United States Patent 11,692,002 (RNA SEQUENCE ADAPTATION) - sequence listing, part 7

SEQ ID NO: 23402 - RNA, 1410 nt, Artificial Sequence
  derived and/or modified CDS sequence (AUadapt) from InfluenzaA__AEM92430__NA
augaaccccaaccagaagaucaugaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 23403 - RNA, 1410 nt, Artificial Sequence
  derived and/or modified CDS sequence (AUadapt) from InfluenzaA__AEM92440__NA
augaaccccaaccagaagaucaucaccaucggcucggugugcaucaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucgcgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaucgcccccaacuaccacuacgaggagugcuccugcuaccccgacucguccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccucgcggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 23404 - RNA, 1410 nt, Artificial Sequence; identical to SEQ ID NO: 23360
  derived and/or modified CDS sequence (AUadapt) from InfluenzaA__AEM92450__NA

SEQ ID NO: 23405 - RNA, 1410 nt, Artificial Sequence; identical to SEQ ID NO: 23360
  derived and/or modified CDS sequence (AUadapt) from InfluenzaA__AEM92460__NA

SEQ ID NO: 23406 - RNA, 1410 nt, Artificial Sequence; identical to SEQ ID NO: 23111
  derived and/or modified CDS sequence (AUadapt) from InfluenzaA__AEM92470__NA

SEQ ID NO: 23407 - RNA, 1410 nt, Artificial Sequence; identical to SEQ ID NO: 23111
  derived and/or modified CDS sequence (AUadapt) from InfluenzaA__AEM92480__NA

SEQ ID NO: 23408 - RNA, 1410 nt, Artificial Sequence
  derived and/or modified CDS sequence (AUadapt) from InfluenzaA__AEM92490__NA
augaaccccaaccagaagaucaucaccaucggcucggugugcaugaucaucgggauggccaaccugaugcuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagucgguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacgaucaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucucgucccggaacggcuucgagaugaucugggaccccaacggguggaccggcaccgacaacaacuucagcaucaagcaggacaucgucgggaucaacgagugguccggcuacagcggguccuucgugcagcacccggagcugaccggccuggacugcauccgccccugcuucuggguggagcucauccggggccgccccaaggagaacacgaucuggaccagcggguccagcaucuccuucugcggcgucaacagcgacaccguggggugguccuggcccgacggcgccgagcugccguucaccaucgacaaguga

SEQ ID NO: 23409 - RNA, 1410 nt, Artificial Sequence
  derived and/or modified CDS sequence (AUadapt) from InfluenzaA__AEM92500__NA
augaaccccaaccagaagaucaucaccaucggcucggugugcaugaucaucgggauggccaaccugaugcuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagucgguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacgaucaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaugggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucucgucccggaacggcuucgagaugaucugggaccccaacggguggaccggcaccgacaacaaguucagcaucaagcaggacaucgucgggaucaacgagugguccggcuacagcggguccuucgugcagcacccggagcugaccggccuggacugcauccgccccugcuucuggguggagcucauccggggccgccccaaggagaacacgaucuggaccagcggguccagcaucuccuucugcggcgucaacagcgacaccguggggugguccuggcccgacggcgccgagcugccguucaccaucgacaaguga

SEQ ID NO: 23410 - RNA, 1410 nt, Artificial Sequence
  derived and/or modified CDS sequence (AUadapt) from InfluenzaA__AEM92520__NA
augaaccccaaccagaagaucaucaccaucggcucggugugcaugaccaucgggauggccaaccugaugcuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucaucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 23411 - RNA, 1410 nt, Artificial Sequence; identical to SEQ ID NO: 23111
  derived and/or modified CDS sequence (AUadapt) from InfluenzaA__AEM92550__NA

SEQ ID NO: 23412 - RNA, 1410 nt, Artificial Sequence
  derived and/or modified CDS sequence (AUadapt) from InfluenzaA__AEM92570__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaaggggaacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 23413 - RNA, 1410 nt, Artificial Sequence
  derived and/or modified CDS sequence (AUadapt) from InfluenzaA__AEM92580__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccaucaugaccgacggcccguccaacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 23414 - RNA, 1410 nt, Artificial Sequence; identical to SEQ ID NO: 23111
  derived and/or modified CDS sequence (AUadapt) from InfluenzaA__AEM92590__NA

SEQ ID NO: 23415 - RNA, 1410 nt, Artificial Sequence; identical to SEQ ID NO: 23111
  derived and/or modified CDS sequence (AUadapt) from InfluenzaA__AEM92600__NA

SEQ ID NO: 23416 - RNA, 1410 nt, Artificial Sequence
  derived and/or modified CDS sequence (AUadapt) from InfluenzaA__AEM92610__NA
augaaccccaaccagaagaucaucaccaucggcucggugugcaugaccaucgggauggccaaccugaugcuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcucgugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucuccuggagcuggcccgacggggccgagcugccguucacgaucgacaaguga

SEQ ID NO: 23417 - RNA, 1410 nt, Artificial Sequence
  derived and/or modified CDS sequence (AUadapt) from InfluenzaA__AEM92620__NA
augaaccccaaccagaagaucaucaccaucggcucggugugcaugaucaucgggauggccaaccugaugcuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcacguucuuccugacccagggcgcccuccuggacgacaagcacuccaacgggaccaucaaggaccggucccccuaccgcacccugaugagcugcccgaucggcgagguccccucccccuacaacagccgguucgagucgguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacgaucaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaugggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucucgucccggaacggcuucgagaugaucugggaccccaacggguggaccggcaccgacaacaaguucagcaucaagcaggacaucgucgggaucaacgagugguccggcuacagcggguccuucgugcagcacccggagcugaccggccuggacugcauccgccccugcuucuggguggagcucauccggggccgccccaaggagaacacgaucuggaccagcggguccagcaucuccuucugcggcgucaacagcgacaccguggggugguccuggcccgacggcgccgagcugccguucaccaucgacaaguga

SEQ ID NO: 23418 - RNA, 1410 nt, Artificial Sequence
  derived and/or modified CDS sequence (AUadapt) from InfluenzaA__AEM92650__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacacgaaguucucgaucaagcaggacaucguggggaucaacgagugguccggcuacagcggguccuucguccagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgccgagcugccguucaccaucgacaaguga

SEQ ID NO: 23419 - RNA, 1410 nt, Artificial Sequence; identical to SEQ ID NO: 21812
  derived and/or modified CDS sequence (AUadapt) from InfluenzaA__AEM98410__NA

SEQ ID NO: 23420 - RNA, 1410 nt, Artificial Sequence; identical to SEQ ID NO: 21812
  derived and/or modified CDS sequence (AUadapt) from InfluenzaA__AEM98421__NA

SEQ ID NO: 23421 - RNA, 1410 nt, Artificial Sequence; identical to SEQ ID NO: 21812
  derived and/or modified CDS sequence (AUadapt) from InfluenzaA__AEM98432__NA

SEQ ID NO: 23422 - RNA, 1410 nt, Artificial Sequence; identical to SEQ ID NO: 23188
  derived and/or modified CDS sequence (AUadapt) from InfluenzaA__AEN55401__NA

SEQ ID NO: 23423 - RNA, 1410 nt, Artificial Sequence; identical to SEQ ID NO: 21415
  derived and/or modified CDS sequence (AUadapt) from InfluenzaA__AEN55411__NA

SEQ ID NO: 23424 - RNA, 1410 nt, Artificial Sequence
  derived and/or modified CDS sequence (AUadapt) from InfluenzaA__AEN55421__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgcgccaguccgucgugagcgugaagcuggccggcaacuccucgcucugcccggucuccgggugggccaucuacagcaaggacaacuccauccggaucggcagcaagggcgacguguucgugauccgcgagcccuucaucuccugcagcccccuggagugccggaccuucuuccugacccagggggcccuccugaacgacaagcacuccaacggcaccaucaaggaccgcagccccuaccggacgcugauguccugcccgaucggggagguccccagccccuacaacucgcgcuucgaguccguggccuggagcgcguccgccugccacgacggcaucaacuggcucaccaucgggaucagcggccccgacaacggcgccguggccguccugaaguacaacgggaucaucaccgacaccaucaaguccuggcggaacaacauccugcgcacgcaggagagcgagugcgugugcgugaacggcuccugcuucaccaucaugaccgacgggccgagcgacggccaggcguccuacaagaucuuccggaucgagaagggcaagaucgucaagagcguggagaugaacgcccccaacuaccacuacgaggagugcuccugcuaccccgacucguccgagaucacgugcgugugccgcgacaacuggcacgggagcaaccggcccugggucuccuucaaccagaaccucgaguaccagaucggcuacaucugcagcgggaucuucggcgacaacccgcgccccaacgacaagaccggguccugcggccccgugagcuccaacggcgccaacggggugaagggcuucagcuucaaguacgggaacggcgucuggaucgggcggaccaagagcaucuccucgcgcaagggcuucgagaugaucugggaccccaacggcuggaccgggaccgacaacaacuucuccaucaagcaggacaucgugggcaucaacgaguggagcggguacuccggcagcuucgugcagcacccggagcugacggggcuggacugcauccggcccugcuucugggucgagcucauccgcggccggcccaaggagaacaccaucuggaccuccggcagcuccaucagcuucugcggggugaacuccgacaccgucggcuggagcuggcccgacggggccgagcugccguucacgaucgacaaguga

SEQ ID NO: 23425 - RNA, 1410 nt, Artificial Sequence
  derived and/or modified CDS sequence (AUadapt) from InfluenzaA__AEN55466__NA
augaaccccaaccagaagaucaucaccaucggcucggugugcaucaccaucgggauggccaaccugauccuccagaucggcaacacgaucuccaucuggaucagccacuccauccagcuggggaaccagaaccagaucgagaccugcaaccagagcgucaucaccuacgagaacaacaccugggugaaccagacguacgugaacaucuccaacaccaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgcgucggccugccacgacgggaucuccuggcucaccaucggcaucagcggccccgacaacggggccguggccguccugaaguacaacggcaucaucaccgacacgaucaaguccuggcgcaacaacauccugcggacccaggagagcgagugcgcgugcgugaacggguccugcuucaccgugaugaccgacggcccgagcgacggccaggccuccuacaagaucuuccgcaucgagaaggggaagaucgucaagucgguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugucguccaacggggccaacggcgugaagggguucagcuucaaguacggcaacggggucuggaucggccgcaccaagagcaucuccagccggaacggcuucgagaugaucugggaccccaacggguggaccggcacggacaacaacuucuccaucaagcaggacaucguggggaucaacgaguggucgggcuacuccgggagcuucgugcagcacccggagcugaccggccuggacugcauccgccccugcuucugggucgagcucauccggggccgccccaaggagaacaccaucuggaccuccgggagcuccaucagcuucugcggcgugaacuccgacacggucggguggagcuggcccgacggcgccgagcugccguucaccaucgacaaguga

SEQ ID NO: 23426 - RNA, 1410 nt, Artificial Sequence
  derived and/or modified CDS sequence (AUadapt) from InfluenzaA__AEN55476__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucgcgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccucgcggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugagcugguccuggcccgacggggccgagcugccguucacgaucgacaaguga

SEQ ID NO: 23427 - RNA, 1410 nt, Artificial Sequence; identical to SEQ ID NO: 22659
  derived and/or modified CDS sequence (AUadapt) from InfluenzaA__AEN55486__NA

SEQ ID NO: 23428 - RNA, 1410 nt, Artificial Sequence; identical to SEQ ID NO: 22659
  derived and/or modified CDS sequence (AUadapt) from InfluenzaA__AEN55506__NA

SEQ ID NO: 23429 - RNA, 1410 nt, Artificial Sequence
  derived and/or modified CDS sequence (AUadapt) from InfluenzaA__AEN55516__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagccgcggggacguguucgugauccgggagcccuucaucuccugcagcccccuggagugccggaccuucuuccugacccagggcgcccuccugaacgacaagcacuccaacgggaccaucaaggaccgcucgcccuaccggacgcugauguccugcccgaucggcgagguccccagccccuacaacagccgcuucgaguccguggccuggagcgcguccgccugccacgacgggaucaacuggcucaccaucggcaucagcggccccgacaacggggccguggccguccugaaguacaacggcaucaucaccgacaccaucaaguccuggcggaacaacauccugcgcacgcaggagucggagugcgcgugcgugaacggguccugcuucaccaucaugaccgacggcccgagcgacggccaggccuccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcagcaaccggcccuggguguccuucaaccagaaccucgaguaccagaucggguacaucugcucgggcaucuucggggacaacccgcgccccaacgacaagaccggcuccugcggccccgucagcuccaacggggccaacggcgugaagggguucagcuucaaguacggcaacgggguguggaucggccggaccaagagcaucuccagccgcaagggcuucgagaugaucugggaccccaacggguggaccggcaccgacaacaacuucuccaucaagcaggacaucgucgggaucaacgaguggucgggcuacuccgggagcuucgugcagcacccggagcugacgggccuggacugcauccggcccugcuucuggguggagcucauccgcggccggcccaaggagaacaccaucuggaccuccgggagcuccaucagcuucugcggcgucaacuccgacaccgugggguggagcuggcccgacggcgccgagcugccguucacgaucgacaaguga

SEQ ID NO: 23430 - RNA, 1410 nt, Artificial Sequence; identical to SEQ ID NO: 22659
  derived and/or modified CDS sequence (AUadapt) from InfluenzaA__AEN55526__NA

SEQ ID NO: 23431 - RNA, 1410 nt, Artificial Sequence; identical to SEQ ID NO: 23188
  derived and/or modified CDS sequence (AUadapt) from InfluenzaA__AEN69429__NA

SEQ ID NO: 23432 - RNA, 1410 nt, Artificial Sequence; identical to SEQ ID NO: 23185
  derived and/or modified CDS sequence (AUadapt) from InfluenzaA__AEN69438__NA

SEQ ID NO: 23433 - RNA, 1410 nt, Artificial Sequence; identical to SEQ ID NO: 21415
  derived and/or modified CDS sequence (AUadapt) from InfluenzaA__AEN69484__NA

SEQ ID NO: 23434 - RNA, 1410 nt, Artificial Sequence; identical to SEQ ID NO: 19087
  derived and/or modified CDS sequence (AUadapt) from InfluenzaA__AEO01627__NA

SEQ ID NO: 23435 - RNA, 1410 nt, Artificial Sequence; identical to SEQ ID NO: 19087
  derived and/or modified CDS sequence (AUadapt) from InfluenzaA__AEO01638__NA

SEQ ID NO: 23436 - RNA, 1410 nt, Artificial Sequence
  derived and/or modified CDS sequence (AUadapt) from InfluenzaA__AEO01644__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaccgacuccucguccagcgggcacugccucgaccccaacaacgaggagggcgggcacggcgugaaggggugggccuucgacgacggcaacgacgucuggaugggccgcaccaucuccgagaagucccggcugggguacgagaccuucaaggugaucgagggcuggucgaaccccaagagcaagcugcagaucaaccgccaggucaucguggaccgggggaaccgcuccggcuacucggggaucuucuccguggagggcaagagcugcaucaaccggugcuucuacgucgagcucauccgcggccggaaggaggagaccgaggugcuguggaccucgaacuccaucguggucuucugcgggacgagcggcaccuacgggaccggcuccuggccggacggggccgacaucaaccugaugcccaucuga

SEQ ID NO: 23437 - RNA, 1410 nt, Artificial Sequence
  derived and/or modified CDS sequence (AUadapt) from InfluenzaA__AEO01654__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggacauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcgggcacugccucgaccccaacaacgaggagggcgggcacggcgugaaggggugggccuucgacgacggcaacgacgucuggaugggccgcaccaucuccgagaagucccggcugggguacgagaccuucaaggugaucgagggcuggucgaaccccaagagcaagcugcagaucaaccgccaggucaucguggaccgggggaaccgcuccggcuacucggggaucuucuccguggagggcaagagcugcaucaaccggugcuucuacgucgagcucauccgcggccggaaggaggagaccaaggugcuguggaccucgaacuccaucguggucuucugcgggaccagcggcacguacgggaccggcuccuggccggacggggccgagaucaaccugaugcccaucuga

SEQ ID NO: 23438 - RNA, 1413 nt, Artificial Sequence; identical to SEQ ID NO: 19034
  derived and/or modified CDS sequence (AUadapt) from InfluenzaA__AEO01665__NA

SEQ ID NO: 23439 - RNA, 1413 nt, Artificial Sequence
  derived and/or modified CDS sequence (AUadapt) from InfluenzaA__AEO01676__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggugaccaagucgaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugaccguggacggcgcgaacggggucaagggcuucagcuacaaguacgacaacggcguguggaucgggcgcacgaaguccaaccggcugcgcaagggcuucgagaugaucugggaccccaacggguggaccaacaccgacagcgacuucuccgugaagcaggacgucguggccaucaccgacuggucgggcuacagcggguccuucgugcagcaccccgagcucacgggccuggacugcauccggcccugcuucugggucgagcuggugcgcggccucccgcgggagaacaccaccaucuggaccucgggguccagcaucuucuuccgcggcgacaacuccgacacggccaacuggagcuggcccgacggggccgagaugaccuucaccaucgacaaguga

SEQ ID NO: 23440 - RNA, 1410 nt, Artificial Sequence; identical to SEQ ID NO: 19087
  derived and/or modified CDS sequence (AUadapt) from InfluenzaA__AEO01693__NA

SEQ ID NO: 23441 - RNA, 1413 nt, Artificial Sequence; identical to SEQ ID NO: 19034
  derived and/or modified CDS sequence (AUadapt) from InfluenzaA__AEO01711__NA

SEQ ID NO: 23442 - RNA, 1410 nt, Artificial Sequence; identical to SEQ ID NO: 23210
  derived and/or modified CDS sequence (AUadapt) from InfluenzaA__AEO37533__NA

SEQ ID NO: 23443 - RNA, 1410 nt, Artificial Sequence
  derived and/or modified CDS sequence (AUadapt) from InfluenzaA__AEO37543__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagccgugcaaccagagcgucaucacguacgagaacaacaccugggugaaccagaccuacgugaacaucuccaacaccaacuucgccgcgggccagagcgucguguccgugaagcuggccgggaacucgucccucugccccgucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccgguccccguaccgcacccugaugucgugccccaucggcgagguccccucccccuacaacagccgguucgagagcguggccugguccgcgagcgccugccacgacgggaucaacuggcucacgaucggcaucuccggcccggacaacggggccguggccguccugaaguacaacggcaucaucaccgacaccaucaagagcuggcgcaacaacauccugcggacccaggaguccgagugcgcgugcgugaacgggucgugcuucacggugaugaccgacggccccuccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgcccgugggucucguucaaccagaaccucgaguaccagaucggguacaucugcuccggcaucuucggggacaacccccggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggacccgaacggguggaccggcaccgacaacaacuucucggugaagcaggacaucaucgggaucaacgagugguccggcuacagcggguccuucgugcagcaccccgagcugaccggccuggacugcauccgccccugcuucugggucgagcucauccggggccgccccaaggagaacacgaucuggaccagcggguccagcaucuccuucugcggcgugaacagcgacaccgucgggugguccuggccggacggcgccgagcugcccuucaccaucgacaaguga

SEQ ID NO: 23444 - RNA, 1410 nt, Artificial Sequence; identical to SEQ ID NO: 22659
  derived and/or modified CDS sequence (AUadapt) from InfluenzaA__AEO72179__NA

SEQ ID NO: 23445 - RNA, 1350 nt, Artificial Sequence
  derived and/or modified CDS sequence (AUadapt) from InfluenzaA__AEO88957__NA
augaaucccaaccagaagaucaucaccaucggcucgaucugcauggugaucgggaucgucucccugaugcuccagaucggcaacaugaucagcaucugggugucccacaguacccagacggggaaccagcaccaggccgagccgauccgcaacaccaacuuccugaccgagaacgccguggcguccgucacccuggccggcaacaguucccucugccccauccgggggugggccgugcacagcaaggacaacuccauccgcaucggcagcaagggcgauguguucgucauccgggagcccuucaucuccugcagccaccuggagugccgcacguucuuucugacccagggggcccuccugaacgacaagcacuccaacggcaccgugaaggaccggagcccccaucgcacccugauguccugcccggugggggaggcccccagccccuacaacucccgguucgagagcgucgcgugguccgccagcgccugucacgacggcacgagcuggcucaccaucgggaucuccggccccgacaacggcgccguggcggugcugaaguacaaugggaucaucaccgacaccaucaagagcuggcgcaacaacauccugcggacgcaggaguccgagugcgccugcgucaacggcaguugcuucaccgugaugaccgacgggccguccaacggccaggccagcuacaagaucuucaagauggagaagggcaagguggucaaguccguggagcucaaugcccccaacuaccacuacgaggagugcagcuguuaccccgacgccggggagaucaucugcgugugccgcgacaacuggcacggcuccaaucggcccugggucagcuucaaccagaaccuggaguaccagaucggguacaucuguuccggcguguucggggacaacccgcgccccaacgacggcaccggcagcugcgggcccgugucccccaauggcgcguacgggaucaagggcuucagcuucaaguacgggaacggcgucuggaucggccggacgaaguccaccaauagccgcuccggguucgagaugaucugggacccgaacggcuggaccgggaccgacagcaacuuuuccgugaagcaggacaucguggccaucacggacuggagcggcuacagcggguccuucguccagcaucccgagcugaccggccucgacugcauccggcccugcuucuggguggagcugauccgcggccggcccaaggagagcaccaucuggaccuccgggagcuccaucagcuuuugcggcgucaacuccgacacggugagcugguccuggccggacggggccgagcugcccuucaccaucgacaaguga

SEQ ID NO: 23446 - RNA, 1350 nt, Artificial Sequence
  derived and/or modified CDS sequence (AUadapt) from InfluenzaA__AEO88965__NA
augaaucccaaccagaagaucaucaccaucggcagcaucugcauggugaucgagaucgucucccugaugcuccagaucgggaacaugaucagcaucugggugucccacaguauccagaccaagaaccagcgccaggccgagccgaucuccaacacgaaguuccugaccgagaaggccguggcgagcgucacccuggccggcaacuccagccucugucccaucuccgggugggccgugcacagcaaggacaacuccauccggaucggcagcaagggggacguguucgucauccgcgagcccuuuaucuccugcagccaccuggagugccggaccuucuuccugacgcagggcgcccuccugaaugacaagcacuccaacggcaccgugaaggaccgcagcccccaccggacccugauguccuguccggugggggaggcccccagccccuacaacucccgcuucgagagcgucgcguggagcgccuccgccugccaugacggcaccagcuggcucacgaucgggaucuccggccccgacaacggggccguggcggugcugaaguacaacggcaucaucaccgauaccaucaagagcuggcggaacaacauccugcgcacccaggaguccgagugcgccugcgucaacggcagcuguuucacggugaugaccgacgggccguccaacggccaggccagcuacaagaucuucaagauggagaaggggaagguggucaaguccguggagcucgaugcccccaacuaccacuacgaggagugcagcuguuaccccgacgccggcgagaucacgugcgugugccgggacaacuggcacggcuccaaucgccccugggucagcuucaaccagaaccuggaguaccagaucggguacaucuguuccggcguguucggggacaacccgcggcccaacgacggcaccgggagcugcggccccgugucccccaauggcgcguacggggucaagggcuucagcuucaaguacgggaacggcguguggaucgggcgcaccaaguccaccaauagccgguccggcuucgagaugaucugggacccgaacggcuggaccgggaccgacagcaguuucuccgugaagcaggacaucgucgccaucacggacuggagcggcuacuccgggagcuucgugcagcaucccgagcugaccggccucaacugcauccgccccugcuucugggucgagcuggugcgggggcgccccaaggaguccaccaucuggaccagcggcuccagcaucuccuuuugcggcgugaacagcgacacggucgggugguccuggccggacggcgccgagcugcccuucaccaucgacaaguga

SEQ ID NO: 23447 - RNA, 1350 nt, Artificial Sequence
  derived and/or modified CDS sequence (AUadapt) from InfluenzaA__AEO88973__NA
augaaucccaaccaaaagaucaucaccaucggcagcaucugcauggugaucgggaucgucucccugaugcuccagaucggcaacaugaucagccugugggugucccacagcauccagaccgggaaucagcaccagguggagccgaucuccaacacgaacuuccugaccgagaaggccgucgccagcgugacccucgcgggcaacuccagccugugucccauccgcgggugggccgugcacuccaaggacaacagcauccggaucggcuccaaaggcgacgucuucgugauccgcgagcccuucaucagcuguucccaccuggagugccggaccuucuuccucacgcagggggcccugcugaacgacaagcacaguaacggcaccgugaaggaccgcagcccccaccggacccucaugagcugcccggucggggaggcccccucccccuacaacagucgcuucgaguccguggccuggagcgcgagcgccugccacgacggcaccuccuggcugacgaucgggaucagcggccccgauaacggcgccguggccguccugaaguacaacgggaugaucaccgacaccaucaaguccuggcggaacaacauccuccgcacccaagagagcgagugcgcgugugugaacggcuccugcuucacggugaugaccgacgggccgagcaacggccaggccuccuacaagaucuuuaagauggagaagggccgggucgugaaguccguggagcuggacgcccccaacuaccacuacgaagagugcuccugcuaucccgacgccggggagaucacgugcgucugccgcgacaacuggcacggcagcaaccggcccuggguguccuuuaaccagaaccuggaguaccagaucggguacaucugcagcggcguguucggggauaacccgcgccccaacgacggcaccggcuccugcgggcccgucagccccaacggcgccuacggggugaagggcuucuccuuuaaguacgggaacggcguguggaucggccggaccaagagcccgaacucccgcagcggguucgagaugaucugggaccccaauggcuggaucgaaaccgacuccagcuucagcgucaagcaggacaucguggcgaucaccgacugguccggguacagcggcuccuuuguccagcaccccgagcucaccgggcuggacugcauccggcccugcuucuggguggagcugauccgcggccggccgaaggagagcacgaucuggaccuccggcagcuccaucaguuucugcggggugaacuccgacaccgucagcugguccuggcccgacggcgccgagcuccccuucaccaucgacaaguga

SEQ ID NO: 23448 - RNA, 1350 nt, Artificial Sequence
  derived and/or modified CDS sequence (AUadapt) from InfluenzaA__AEO88982__NA
augaaucccaaccagaagaucaucaccaucggcucgaucugcauggugaucgggaucgucucccugaugcuccagaucggcaacaugaucagcaucugggugucccacaguauccagaccgggaaccagcaccaggccgagccgauccgcaacacgaacuuccugaccgagaacgccguggcguccgucacccuggccggcaacaguucccucugccccgugcgggggugggccgugcacagcaaggacaacuccauccgcaucggcagcaagggcgaugucuucgugauccgggagcccuucaucuccugcagccaccuggagugccgcaccuucuuucugacgcagggggcccuccugaacgacaagcacuccaacggcaccgugaaggaccggagcccccaccgcacccugauguccuguccggucggggaggcccccagccccuacaacucccgguucgagagcguggcgugguccgccagcgccugucacgacggcaccagcuggcucacgaucgggaucuccggccccgacaacggcgccguggcgguccugaaguacaacgggaucaucaccgauaccaucaagagcuggcgcaacaacauccugcggacccaggaguccgagugcgccugcgugaacggcaguugcuucacggugaugaccgacgggccguccaacggccaggccagcuacaagaucuucaagauggagaagggcaaggucgugaaguccguggagcucaaugcccccaacuaccacuacgaggagugcagcugcuaucccgacgccggggagaucacgugcgucugccgcgacaacuggcacggcuccaaucggcccugggugagcuucaaccagaaccuggaguaccagaucggguacaucugcuccggcaucuuuggggacaacccgcgcccccacgacggcaccggcagcugcgggcccgugucccccaauggcgcguacgggaucaagggcuucagcuucaaguacgggaacggcgucuggaucggccggaccaaguccaccaacagucgcuccggguucgagaugaucugggacccgaacggcuggaccgggaccgacagcaacuucuccgugaagcaggauaucguggccaucacggacuggagcggcuacagcggguccuucguccagcaccccgagcugaccggccucgauugcauccggcccugcuucuggguggagcugauccgcggccggcccaaggagagcaccaucuggaccuccgggagcuccaucagcuucuguggcgucaacuccgacacggugagcugguccuggccggacgacgccgagcugcccuucaccaucgacaaguga

SEQ ID NO: 23449 - RNA, 1350 nt, Artificial Sequence
  derived and/or modified CDS sequence (AUadapt) from InfluenzaA__AEO88990__NA
augaaucccaaccagaagaucaucaccaucggcucgaucugcauggugaucgggaucgucucccugaugcuccagaucggcaacaugaucagcaucugggugucccacaguauccagaccgggaaccagcaccaggccgagccgauccgcaacacgaacuuccugaccgagaacgccguggcguccgucacccuggccggcaacaguucccucugccccgugcgggggugggccgugcacagcaaggacaacuccauccgcaucggcagcaagggcgaugucuucgugauccgggagcccuucaucuccugcagccaccuggagugccgcaccuucuuucugacgcagggggcccuccugaacgacaagcacuccaacggcaccgugaaggaccggagcccccaccgcacccugauguccuguccggucggggaggcccccagccccuacaacucccgguucgagagcguggcgugguccgccagcgccugucacgacggcaccagcuggcucacgaucgggaucuccggccccgacaacggcgccguggcgguccugaaguacaacgggaucaucaccgauaccaucaagagcuggcgcaacaacauccugcggacccaggaguccgagugcgccugcgugaacggcaguugcuucacggugaugaccgacgggccguccaacggccaggccagcuacaagaucuucaagauggagaagggcaaggucgugaaguccguggagcucaaugcccccaacuaccacuacgaggagugcagcugcuaucccgacgccggggagaucacgugcgucugccgcgacaacuggcacggcuccaaucggcccugggugagcuucaaccagaaccuggaguaccagaucggguacaucugcuccggcguguuuggggacaacccgcgccccaacgacggcaccggcagcugcgggcccgucucccccaauggcgcguacgggaucaagggcuucagcuucaaguacgggaacggcguguggaucggccggaccaaguccaccaacagucgcuccggguucgagaugaucugggacccgaacggcuggaccgggaccgacagcaacuucuccgugaagcaggauaucgucgccaucacggacuggagcggcuacagcggguccuucgugcagcaccccgagcugaccggccucgauugcauccggcccugcuucugggucgagcugauccgcggccggcccaaggagagcaccaucuggaccuccgggagcuccaucagcuucuguggcgugaacuccgacacggugagcugguccuggccggacgacgccgagcugcccuucaccaucgacaaguga

SEQ ID NO: 23450 - RNA, 1350 nt, Artificial Sequence
  derived and/or modified CDS sequence (AUadapt) from InfluenzaA__AEO88998__NA
augaaucccaaccagaagaucaucaccaucggcucgaucugcauggugaucgggaucgucucccugaugcuccagaucggcaacaugaucagcaucugggugucccacagcauccagaccgggaaucagcaccaggccgagccgauccgcaacacgaacuuccugaccgagaacgccguggcguccgucacccuggccggcaacagcucccucugccccauccgggggugggccgugcauagcaaggacaacuccauccgcaucggcagcaagggcgacguguucgucauccgggagcccuucaucuccuguagccaccuggagugccgcaccuucuuccugacgcagggggcccuccugaacgacaagcacuccaauggcaccgugaaggaccggagcccccaccgcacccugauguccugcccggugggggaggcccccagccccuacaacucccgguuugagagcgucgcgugguccgccagcgccugccacgacggcaccagcuggcucacgaucgggaucuccggccccgacaacggcgccguggcggugcugaaguauaacgggaucaucaccgacaccaucaagagcuggcgcaacaacauccugcggacccaggaguccgagugcgccugcgucaauggcucgugcuucacggugaugaccgacgggccguccaacgagcaggccagcuacaagaucuucaagauggagaagggcaagguggucaaguccguggagcucaaugcccccaacuaccacuacgaggagugcagcugcuaucccgacgccggcgagaucaucugcgugugccgcgacaacuggcacggguccaaccggcccugggucagcuuuaaccagaaccuggaguaccagaucggcuacaucugcuccgggguguucggcgacaauccgcgccccaacgacgggaccggcagcugcggccccgugucccccaacggggcguacggcaucaagggguucagcuuuaaguacggcaacggggucuggaucggccggaccaaguccacgaacagccgcuccggcuucgagaugaucugggacccgaacggguggaccggcaccgauagcaacuucuccgugaagcaggacaucguggccaucaccgacuggagcggguacagcggcuccuuuguccagcaccccgagcugacggggcucgacugcauccggcccugcuucuggguggagcugauccgcggccggcccaaggagagcaccaucuggaccuccggcagcuccaucaguuucugcggggucaacuccgacaccgugagcugguccuggccggacggcgccgagcugcccuucacgaucgacaaguga

SEQ ID NO: 23451 - RNA, 1350 nt, Artificial Sequence
  derived and/or modified CDS sequence (AUadapt) from InfluenzaA__AEO89006__NA
augaaucccaaccagaagaucaucaccaucggcagcaucugcauggugaucgggaucgucucccugaugcuccagaucggcaacaugaucagcaucugggugucccacaguauccagaccgggaaccagcaccaggccgagccgauccgcaacacgaacuuccugaccgagaacgccguggcguccgucacccuggccggcaauagcucccucugccccgugcgggggugggccgugcacagcaaggacaacuccauccgcaucggcaguaagggcgacgucuucgugauccgggagcccuucaucuccugcagccaccuggagugucgcaccuucuuccugacgcagggggcccuccugaacgacaagcacuccaacggcaccgugaaggaucggagcccccaccgcacccugauguccugcccggucggggaggcccccagccccuacaacucccgguuugagagcguggcgugguccgccagcgccugccacgacggcaccagcuggcucacgaucgggaucuccggccccgacaauggcgccguggcgguccugaaguacaacgggaucaucaccgacaccaucaagagcuggcgcaacaacauccugcggacccaggaguccgagugugccugcgugaacggcagcugcuucacggugaugaccgacgggccguccaauggccaggccagcuacaagaucuucaagauggagaagggcaaggucgugaaguccguggagcucaacgcccccaacuaccauuacgaggagugcagcugcuaccccgacgccggggagaucacgugugucugccgcgacaacuggcacggcuccaaccggcccugggugagcuuuaaccagaaccuggaguaccagaucggguacaucugcuccggcguguucggggacaauccgcgccccaacgacggcaccggcagcugcgggcccgucucccccaacggcgcguacgggaucaagggcuuuagcuucaaguacgggaacggcguguggaucggccggaccaaguccaccaacagccgcuccggguuugagaugaucugggacccgaacggcuggaccgggaccgacagcgacuucuccgugaagcaggauaucaucgccaucacggacuggagcggcuacagcggguccuucguccagcaccccgagcugaccggccucgauugcauccggcccugcuucuggguggagcugauccgcggccggcccaaggagagcaccaucuggaccuccgggagcuccaucagcuuuugcggcgucaacuccgacacggugagcugguccuggccggacggggccgagcugcccuucaccaucgacaaguga

SEQ ID NO: 23452 - RNA, 1350 nt, Artificial Sequence
  derived and/or modified CDS sequence (AUadapt) from InfluenzaA__AEO89023__NA
augaaucccaaccaaaagaucaucaccaucggcagcaucugcauggugaucgggaucgucucccugaugcuccagaucggcaacauggugagccugugggugucccacaguauccagaccgggaaccagcaccaggucgagccgaucuccaacacgaacuuccugaccgagaaggccguggccagcgugacccucgcgggcaacuccagucugugccccauccgcgggugggccguccacuccaaggacaacagcauccggaucggcuccaaaggcgacguguucgugauccgcgagcccuuuaucagcugcucccaccuggagugccggaccuucuuccucacgcagggggcccugcugaacgauaagcacagcaacggcaccgucaaggaccgcagcccccaccggacccucaugagcuguccggugggggaggcccccucccccuacaacagccgcuucgaguccguggccuggagcgcgagcgccugccaugacggcaccuccuggcugacgaucgggaucagcggccccgacaacggcgccgucgccgugcugaaguacaacgggaugaucaccgacaccaucaaguccuggcggaauaacauccuccgcacccaagagagcgagugcgcgugcgugaacggcuccugcuucacggucaugaccgaugggccgagcaacggccaggccuccuacaagaucuucaagauggagaagggcaagguggugaaguccgucgagcuggacgcccccaacuaccauuacgaagagugcuccugcuaccccgacgccggggagaucacgugcgugugccgggauaacuggcacggcagcaaccgccccuggguguccuucaaccagaaccuggaguaucagaucggguacaucugcagcggcgucuucggggacaacccgcggcccaacgauggcaccggcuccugcgggcccgugagccccaacggcgccuacggggugaagggcuucuccuucaaguacgggaauggcgucuggaucggccgcaccaagagcccguccagccgguccggguucgagaugaucugggaccccaacggcuggaccgaaaccgacagcaguuucuccgugaagcaggacaucgucgcgaucaccgacuggagcggguacuccggcagcuucgugcagcaucccgagcucacggggcuggacugcauccgccccugcuucuggguggagcugauccggggccgcccgaaggaguccaccaucuggaccagcggcuccagcaucuccuucuguggggucaacagcgacaccguguccuggagcuggcccgacggcgccgagcuccccuucacgaucgacaaguga

SEQ ID NO: 23453 - RNA, 1350 nt, Artificial Sequence
  derived and/or modified CDS sequence (AUadapt) from InfluenzaA__AEO89032__NA
augaaucccaaccagaagaucaucaccaucggcagcaucugcauggugaucgggaucgucucccugaugcuccagaucggcaacaugaucagcaucugggugucccacaguauccagaccgggaaccagcaccaggccgagccgauccgcaacacgaacuuccugaccgagaacgccguggcguccgucacccuggccggcaauagcucccucugccccgugcgggggugggccgugcacagcaaggacaacuccauccgcaucggcaguaagggcgacgucuucgugauccgggagcccuucaucuccugcagccaccuggagugucgcaccuucuuccugacgcagggggcccuccugaacgacaagcacuccaacggcaccgugaaggaucggagcccccaccgcacccugauguccugcccggucggggaggcccccagccccuacaacucccgguuugagagcguggcgugguccgccagcgccugccacgacggcaccagcuggcucacgaucgggaucuccggccccgacaauggcgccguggcgguccugaaguacaacgggaucaucaccgacaccaucaagagcuggcgcaacaacauccugcggacccaggaguccgagugugccugcgugaacggcagcugcuucacggugaugaccgacgggccguccaauggccaggccagcuacaagaucuucaagauggagaagggcaaggucgugaaguccguggagcucaacgcccccaacuaccauuacgaggagugcagcugcuaccccgacgccggggagaucacgugugucugccgcgacaacuggcacggcuccaaccggcccugggugagcuuuaaccagaaccuggaguaccagaucggguacaucugcuccggcguguucggggacaauccgcgccccaacgacggcaccggcagcugcgggcccgucucccccaacggcgcguacgggaucaagggcuuuagcuucaaguacgggaacggcguguggaucggccggaccaaguccaccaacagccgcuccggguuugagaugaucugggacccgaacggcuggaccgggaccgacagcaacuucuccgugaagcaggauaucgucgccaucacggacuggagcggcuacagcggguccuucgugcagcaccccgagcugaccggccucgauugcauccggcccugcuucugggucgagcugauccgcggccggcccaaggagagcaccaucuggaccuccgggagcuccaucagcuuuugcggcgugaacuccgacacggugagcugguccuggccggacggggccgagcugcccuucaccaucgacaaguga

SEQ ID NO: 23454 - RNA, 1350 nt, Artificial Sequence
  derived and/or modified CDS sequence (AUadapt) from InfluenzaA__AEO89041__NA
augaaucccaaccagaagaucaucaccaucggcagcaucugcauggugaucgggcuggucucccucaugcugcagaucggcaacaugaucagcaucugggugucccacaguauccagaccgggaaccagcaccaggccgagccgauccgcaacacgaacuuccugaccgagaacgccguggcguccgucacccucgccggcaauagcucccugugccccgugcgggggugggccgugcacagcaaggacaacuccauccgcaucggcaguaagggcgacgucuucgugauccgggagcccuucaucuccugcagccaccuggagugucgcaccuucuuccucacgcagggggcccugcugaacgacaagcacuccaacggcaccgugaaggaucggagcccccaccgcacccucauguccugcccggucggggaggcccccagccccuacaacucccgguuugagagcguggcgugguccgccagcgccugccacgacggcaccagcuggcugacgaucgggaucuccggccccgacaauggcgccguggcgguccugaaguacaacgggaucaucaccgacaccaucaagagcuggcgcaacaacauccuccggacccaggaguccgagugugccugcgugaacggcagcugcuucacggugaugaccgacgggccguccaauggccaggccagcuacaagaucuucaagauggagaagggcaaggucgugaaguccguggagcugaacgcccccaacuaccauuacgaggagugcagcugcuaccccgacgccggggagaucacgugugucugccgcgacaacuggcacggcuccaaccggcccugggugagcuuuaaccagaaccuggaguaccagaucggguacaucugcuccggcguguucggggacaauccgcgccccaacgacggcaccggcagcugcgggcccgucucccccaacggcgcguacgggaucaagggcuuuagcuucaaguacgggaacggcguguggaucggccggaccaaguccaccaacagccgcuccggguuugagaugaucugggacccgaacggcuggaccgggaccgacagcaacuucuccgugaagcaggauaucgucgccaucacggacuggagcggcuacagcggguccuucgugcagcaccccgagcucaccggccuggauugcauccggcccugcuucuggaucgagcugauccgcggccggcccaaggagagcaccaucuggaccuccgggagcuccaucagcuuuugcggcgucaacuccgacacggugagcugguccuggccggacggggccgagcuccccuucaccaucgacaaguga

SEQ ID NO: 23455 - RNA, 1350 nt, Artificial Sequence
  derived and/or modified CDS sequence (AUadapt) from InfluenzaA__AEO89050__NA
augaaucccaaccagaagaucaucaccaucggcucgaucugcauggugaucgggaucgucucccugaugcuccagaucggcaacaugaucagcaucugggugucccacagcauccagaccgggaaucagcaccaggccgagccgauccgcaacacgaacuuccugaccgagaacgccguggcguccgucacccuggccggcaacagcucccucugucccauccgggggugggccgugcacagcaaggacaacuccauccgcaucggcagcaagggcgacguguucgucauccgggagcccuuuaucuccugcagccaccuggagugccgcaccuucuuccugacgcagggggcccuccugaacgauaagcacuccaacggcaccgugaaggaccggagcccccaccgcacccugauguccugcccgaugggggaggcccccagccccuauaacucccgguucgagagcguggcgugguccgccagcgccugccacgacggcaccaguuggcucacgaucgggaucuccggccccgacaacggcgccgucgcggugcugaaguacaacgggaucaucaccgacaccaucaagagcuggcgcaacaauauccugcggacccaggaguccgagugcgccugcgugaacggcagcugcuucacggucaugaccgacgggccguccaauggccaggccagcuacaagaucuucaagauggagaagggcaagguggugaaguccgucgagcucaacgcccccaacuaccacuaugaggagugcagcugcuaccccgacgccggggagaucaucugcgugugccgcgauaacuggcacggcuccaaccggcccugggugagcuucaaccagaaccuggaguaucagaucggguacaucugcuccggcgucuucggggacaacccgcgccccaacgacggcaccggcaguugcgggcccgugucccccaacggcgcguacgggaucaagggcuucagcuucaaguacgggaauggcguguggaucggccggaccaaguccacgaacagccgcuccggguucgagaugaucugggacccgaacggcuggaccgggaccgacagcgauuucuccgucaagcaggacaucguggccaucaccgacuggagcggcuacagcggguccuucgugcagcaucccgagcugacgggccucgacugcauccggcccugcuucugggucgagcugauccgcggccggcccaaggagagcaccaucuggaccuccgggagcuccaucagcuuuugcggcgugaacuccgacaccgucagcugguccuggccggacggggccgagcugcccuucacgaucgacaaguga

SEQ ID NO: 23456 - RNA, 1350 nt, Artificial Sequence
  derived and/or modified CDS sequence (AUadapt) from InfluenzaA__AEO89058__NA
augaaucccaaccaaaagaucaucaccaucggcagcaucugcauggugaucgggaucgucucccugaugcuccagaucggcaacaugaucagcaucugggugucccacaguauccagaccgggaaccagcgccaggccgagccgaucuccaacacgaaguuccugaccgagaaggccguggcgagcgucacccuggccggcaacuccagccucugccccaucuccgggugggccguguauagcaaggacaacuccauccggaucggcagccgcggcgacguguucgucauccgggagcccuucaucuccuguagccaccuggaaugccgcaccuucuuccugacgcagggggcccuccugaacgacaagcauuccaacggcaccgugaaggaccggagcccccaccgcacccugauguccugcccggugggggaggcccccagccccuacaauucccgguucgagagcgucgcguggagcgccuccgccugccacgacggcaccagcuggcucacgaucgggaucuccggccccgauaacggcgccguggcggugcugaaguacaacgggaucaucaccgacaccaucaagagcuggcgcaacaacauccugcggacccaggaguccgagugugccugcgucaacggcagcugcuucacggugaugaccgacgggccguccaacggccaggccaguuacaagaucuucaaaauggagaagggcaagguggucaaguccguggagcucgacgcccccaacuaccacuacgaggaguguagcugcuaccccgacgccggggagaucacgugcgugugccgcgacaauuggcacggcuccaaccggcccugggucagcuucaaccagaaccuggacuaucagaucggguacaucugcuccggcguguucggggacaacccgcgccccaacgacggcaccggcaguugcgggcccgugucccccaacggcgcguacggggucaagggcuucagcuucaaauacgggaauggcguguggaucggccggaccaaguccaccaacagccgcuccggguucgagaugaucugggacccgaacggcuggaccgggaccgacagcaguuucuccgugaagcaggacaucgucgccaucacggacuggagcggcuacuccgggagcuucgugcagcaucccgagcugaccggccucgacugcauccggcccugcuucugggucgagcugauccgcggccggcccaaggaguccaccaucuggaccagcggguccagcaucuccuucuguggcgugaacagcgacacgguguccuggagcuggccggacggggccgagcugcccuucaccaucgacaaguga

SEQ ID NO: 23457 - RNA, 1350 nt, Artificial Sequence
  derived and/or modified CDS sequence (AUadapt) from InfluenzaA__AEO89075__NA
augaaucccaaccaaaagaucaucaccaucggcagcaucugcauggugaucgggaucgucucccugaugcuccagaucggcaacaugaucagcaucugggugucccacagcauccagcgcgggaaccugaaucagguggagccgaucuccaacaccaacuuccugacggagaaggccgucgccagcgugacccucgcgggcaacuccagccugugccccauccgggggugggccauccacuccaaggauaacagcauccgcaucggcuccaagggcgacguguucgucauccgggagcccuucaucagcugcucccaccuggagugucgcaccuucuuccucacccagggggcccugcugaacgacaagcacagcaacggcacggugaaggaccggaguccccaccgcacccucauguccugcccggugggggagguccccucccccuacaacagccgguucgaguccguggccuggagcgccagcgcgugucacgacggcaccuccuggcugaccaucgggaucagcggccccgacaacggcgccguggccgucgugaaguacaacgggaucaucacggacaccaucaaguccuggcgcaauaacauccugcggacccaggagagcgagugcgccugcgugaacggcuccugcuucaccgucaugacggacgggccgaguaacggccaggcguccuacaagaucuucaagauggagaagggcaaggugaucaagagcguggagcucgacgcccccaacuaccacuaugaggagugcuccugcuaccccgacgccggggagaucacgugcgucugccgcgacaacuggcauggcagcaaccggcccuggguguccuucaaccagaaccuggaguaccagaucggguacaucugcaguggcguguucggggacaacccgcgccccaacgacggcaccggcuccugcgggcccgucagccccaacggcgccuauggggugaagggcuucuccuucaaguacgggaacggcguguggaucggccggaccaagagcccgaacucccgcagcggguucgagaugaucugggaucccaacggcugguccgagaccgacagcagcuucuccgucaagcaggacaucguggccaucaccgacuggagcggguauuccggcagcuucguccagcaccccgagcugaccgggcucgacugcauccggcccugcuucuggguggagcugauccgcggccggccgaaggaguccaccaucuggacgagcggcuccaguaucuccuucugcggggugaacagcgacaccgucuccuggagcuggcccgacggcgcggagcugcccuucaccaucgacaaguga

SEQ ID NO: 23458 - RNA, 1350 nt, Artificial Sequence
  derived and/or modified CDS sequence (AUadapt) from InfluenzaA__AEO89084__NA
augaaucccaaccaaaagaucaucaccaucggcagcaucugcauggugaucgggaucgucucccugaugcuccagaucggcaacaugaucagcaucuggaucuccuacaguauccagaccgggaaccagcaccaggccgagccgacgcgcaacgccaccuuccugaccgagaacgcgguggccuccgugacccuggccggcaacaguucccucugccccguccgggggugggccgugcacagcaaggacaacuccauccgcaucggcagcaagggcgacguguuugucauccgggagcccuucaucuccugcagccaccuggagugccgcacguucuuucugacccagggggcccuccugaacgacaagcacuccaacggcaccgugaaggaccggagcccccaccgcacccugauguccuguccggugggggaggcgcccagccccuacaacucccgguucgagagcgucgccugguccgccagcgccugucacgacggcacgagcuggcucaccaucgggaucuccggccccgacaacggcgcgguggccgugcugaaguacaacgggaucaucaccgauaccaucaagagcuggcgcaacaacauccugcggacgcaggaguccgagugcgccugcgucaacggcaguugcuucaccgugaugaccgacgggccguccgacggccaggccagcuacaagaucuucaagauggaaaagggcaagguggucaaguccguggagcucaucgcccccaauuaccacuacgaggagugcagcugcuaucccgacgcgggggagaucacgugcgugugccgcgacaacuggcacggcuccaaucggcccugggucagcuucaaccagaaccuggaguaccagaucggguacaucugcuccggcguguuuggggacaacccgcgccccaacgacggcaccggcagcugcgggcccgugucccccaauggcgccuacgggaucaagggcuucagcuucaaguacgggaacggcgucuggaucggccggaccaaguccaccaacagucgcuccggguucgagaugaucugggacccgaacggcuggaccgagacggacagcaacuuuuccgugaagcaggacaucguggccaucaccgacuggagcggguacagcggcuccuucguccagcaccccgagcugaccgggcucgauugcauccggcccugcuucuggguggagcugauccgcggccggcccaaggagagcaccaucuggacguccggcagcuccaucagcuuuugcggggucaacuccgacaccgugagcugguccuggccggacggcgccgagcugcccuucaccaucgacaaguga

SEQ ID NO: 23459 - RNA, 1350 nt, Artificial Sequence
  derived and/or modified CDS sequence (AUadapt) from InfluenzaA__AEO89093__NA
augaaucccaaccaaaagaucaucaccaucggcagcaucugcauggugaucgggaucgucucccugaugcuccagaucggcaacaugaucagccugugggugucccacagcauccagaccgggaaucagcaccagguggagccgaucuccaacacgaacuuccuggucgagaaggccguggccagcgugacccucgcgggcaacuccagccugugccccauccgcgggugggccguccauuccaaggacaacagcauccggaucggcuccaaaggcgacguguucgugauccgcgagcccuucaucagcuguucccaccuggagugccggaccuucuuccucacccagggggcccugcugaacgacaagcacagcaauggcacggucaaggaccgcagcccccaccggacccucaugagcugcccggugggggaggcccccucccccuacaacagucgcuucgaguccguggccuggagcgcgagcgccugccacgacggcaccuccuggcugaccaucgggaucagcggccccgacaauggcgccgucgccgugcugaaguacaacgggaugaucacggacaccaucaaguccuggcggaacaacauccuccgcacccaagagagcgagugcgcgugugugaacggcuccugcuucaccgucaugacggacgggccgagcaacggccaggccuccuacaagaucuucaagauggagaagggccggguggugaaguccgucgagcuggaugcccccaacuaccacuacgaagagugcuccugcuaccccgaugccggggagaucacgugcgugugccgcgacaacuggcacggcagcaaccggcccuggguguccuucaaucagaaccuggaguaccagaucggguacaucugcagcggcgucuucggggacaauccgcgccccaacgacggcaccggcuccugcgggcccgugagcuccaacggcgccuacggggugaagggcuucagcuuuaaguacgggaacggcgucuggaucggccggaccaagucccccaacagccgcuccggguucgagaugaucugggacccgaacggcuggaccgaaaccgauagcagcuucuccgugaagcaggacaucgucgcgaucaccgacuggagcggguacuccggcagcuuugugcagcaccccgagcucaccgggcuggacugcauccggcccugcuucuggguggagcugauccgcggccggcccaaggaguccacgaucuggaccagcggcuccagcaucuccuuuugcggggucaacagcgacaccguguccuggagcuggccggacggcgccgagcuccccuucaccaucgacaaguga

SEQ ID NO: 23460 - RNA, 1350 nt, Artificial Sequence
  derived and/or modified CDS sequence (AUadapt) from InfluenzaA__AEO89102__NA
augaaucccaaccagaagaucaucaccaucggcagcaucugcauggugaucgggaucgucucccugaugcuccagaucggcaacaugaucagcaucuggaucucccacagcauccagaccgggaaccagaaucagguggagccgaucuccaacacgaacuuccugaccgagaaggccguggccagcgucauccuggcgggcaacuccagccucugccccauccgcgggugggccauccacuccaaggauaacagcauccggaucggcuccaagggcgacguguucgugauccgcgagcccuucaucagcugcucccaccuggagugucggaccuucuuccugacccagggggcccuccugaacgacaagcacagcaacggcacggucaaggaccgcaguccccaccggacccugauguccugcccggugggggaggcccccucccccuacaacagccgcuucgaguccguggccuggagcgcgagcgccugucacgacggcaccuccuggcucaccaucgggaucagcggccccgacuccggcgccgucgccgugcugaaguacaacgggaucaucacggacaccaucaagagcuggcggaauaacauccugcgcacccaggaguccgagugcgcgugcgugaacggcagcugcuucaccgucaugacggacgggccguccaauggccaggccagcuacaagaucuucaagauggagaagggcaaggugaucaaguccguggagcucgacgcccccaacuaccacuacgaggaguguagcugcuaccccgacgccggggagaucacgugcgucugccgggacaacuggcauggcuccaaccgccccugggugagcuucaaccagaaccuggaguaccagaucggguacaucugcuccggcguguuuggggacaacccgcggcccaacgacggcaccggcagcugcgggcccgucucccacaacggcgccuauggggugaagggcuucagcuucaaguacgggaacggcguguggaucggccgcaccaagucccccaacagccgguccggguucgagaugaucugggauccgaacggcuggagcgagaccgacagcuccuucagcgucaagcaggacaucguggcgaucaccgacugguccggguauagcggcuccuucgugcagcaccccgagcugaccgggcucgacugcauccgccccugcuucugggucgagcugauccggggccgccccaaggagagcaccguguggacguccggcaguuccaucagcuucugcggggucaacuccgacaccgugagcugguccuggccggacggcgccgagcugcccuucaccaucgacaaguga

SEQ ID NO: 23461 - RNA, 1350 nt, Artificial Sequence
  derived and/or modified CDS sequence (AUadapt) from InfluenzaA__AEO89111__NA
augaaucccaaccagaagaucaucaccaucggcucgaucugcauggugaucgggaucgucucccugaugcuccagaucggcaacaucaucagcaucugggugucccacaguauccagaccgggaaccagcaccaggacgagccgauccgcaacgccaacgugcugacggagaacgccgucgcguccgugacccuggccggcaacaguucccucugccccgugcgggggugggccguccacagcaaggacaacuccauccgcaucggcagcaagggcgauguguucgugauccgggagcccuucaucuccugcagccaccuggagugccgcaccuucuuucugacccagggggcccuccugaacgacaagcacuccaacggcacggucaaggaccggagcccccaccgcacccugauguccuguccggugggggaggcccccagccccuacaacucccgguucgagagcguggcgugguccgccagcgccugucacgacggcaccagcuggcucaccaucgggaucuccggccccgacaacggcgccgucgcggugcugaaguacaacgggaucaucacggauaccaucaagagcuggcgcaacaacauccugcggacccaggaguccgagugcgccugcgugaacggcaguugcuucaccgucaugacggacgggccguccaacggccaggccagcuacaagaucuucaagauggagaagggcaagguggugaaguccgucgagcucaaugcccccaacuaccacuacgaggagugcagcugcuaucccgacgccggggagaucacgugcgugugccgcgacaacuggcacggcuccaaucggcccugggugagcuucaaccagaaccuggaguaccagaucggguacaucugcuccggcgucuuuggggacaacccgcgccccaacgacggcaccggcagcugcgaucccgugucccccaacggggcguacggcaucaagggguucagcuucaaguacggcaacgggguguggaucggccggaccaaguccaccaauagccgcuccggcuucgagaugaucugggacccgaacggguggaccgagaccgacagcaacuuuuccgucaagcaggacaucguggccaucaccgacuggagcggcuacagcggguccuucguccagcaucccgagcugacgggccucgacugcauccggcccugcuucuggguggagcugauccgcgggcggcccaaggagagcaccaucuggaccuccggcagcuccaucagcuuuugcggcgugaacuccgacaccgucagcugguccuggccggacggggccgagcugcccuucacgaucgacaaguga

SEQ ID NO: 23462 - RNA, 1350 nt, Artificial Sequence
  derived and/or modified CDS sequence (AUadapt) from InfluenzaA__AEO89120__NA
augaaucccaaccaaaagaucaucaccaucggcagcaucugcauggugaucgggaucgucucccugaugcuccagaucggcaacaugaucagcaucugggugucccacaguauccagaccgggaaccagcaccaggccgagccgauccgcaacgccuccuuccugacggagaacgcgguggccagcgucacccuggccggcaacuccagucucugccccgugcgggggugggccgugcacuccaaggacaacagcauccgcaucggcuccaagggcgacgucuuugugauccgggagcccuucaucagcugcucccaccuggagugccgcaccuucuuccugacccagggggcccuccugaaugacaagcacagcaacggcacggugaaggaccggagcccccaucgcacccugaugagcugcccggucggggaggcgcccucccccuacaacagccgguucgaguccguggccuggagcgccagugccugccacgacggcaucuccuggcucaccaucgggaucagcggccccgacaacggcgcgguggccguccugaaauauaacgggaucaucaccgacacgaucaaguccuggcgcaacaacauccugcggacccaggagagcgagugcgccugcgugaauggcuccugcuucaccgugaugaccgacgggccgagcaacggccaggccuccuacaagaucuuuaagauggagaagggcaaggucgugaaguccguggagcucaacgcccccaacuaccacuacgaggagugcuccugcuaucccgacgcgggggagaucacgugcgucugccgcgacaacuggcacggcaguaaccggcccuggguguccuucaaccagaaccuggaauaccagaucggguacaucugcaguggcguguucggggacaacccgcgccccaacgacggcaccggcuccugcgggcccgucagucccaacggcgccuacgggaucaagggcuucuccuucaaguacgggaacggcguguggaucggccggaccaagagcaccaauucccgcagcggguucgagaugaucugggacccgaacggcugggccgagacggacuccaacuuuagcgugaagcaggacaucgucgccaucaccgacuggagcggguacuccggcagcuucgugcagcaucccgagcugaccgggcucgacugcauccggcccugcuucugggucgagcugauccgcggccggcccaaggagggcaccaucuggacguccgggagcuccaucagcuuuugcggcgugaacuccgacaccgugagcugguccuggccggacggggccgagcugcccuucaccaucgacaaguga

SEQ ID NO: 23463 - RNA, 1350 nt, Artificial Sequence
  derived and/or modified CDS sequence (AUadapt) from InfluenzaA__AEO89129__NA
augaaucccaaccagaagaucaucaccaucggcucgaucugcauggugaucgggaucgucucccugaugcuccagaucggcaacaucaucagcaucugggugucccacaguacccagacggggaaccagcaccaggacgagccgauccgcaacgccaacuuccugaccgagaaugccguggcguccgucacccuggccggcaacagcucccucugccccgugcgggggugggccgugcacagcaaggacaauuccauccgcgucggcagcaagggcgacguguucgugauccgggagcccuucaucuccugcagccaccuggagugucgcaccuucuuccugacgcagggggcccuccugaacgacaagcacuccaacggcaccgucaaggaucggagcccccaccgcacccugauguccugcccggugggggaggcccccagccccuacaacucccgguuugagagcguggcgugguccgccagcgccugccacgacggcaccagcuggcucacgaucgggaucuccggccccgauaacggcgccgucgcggugcugaaguacaacgggaucaucaccgacaccaucaagagcuggcgcaacaacauccugcggacccaggaguccgagugugccugcgugaacggcagcugcuucacggucaugaccgacgggccguccaauggccaggccagcuacaagaucuucaagauggagaagggcaagguggugaaguccgucgagcucaacgcccccaacuaccauuacgaggagugcagcugcuaccccgacgccggggagaucacgugugugugccgcgacaacuggcacggcuccaaccggcccugggugagcuucaaucagaaccuggaguaccagaucggguacaucugcuccggcgucuucggggacaauccgcgccccaacgacggcaccggcagcugcgaccccgugucccccaacggggcguauggcaucaagggguucagcuucaaguacggcaacgggguguggaucggccggaccaaguccaccaacagucgcuccggcuucgagaugaucugggacccgaacggguggaccgagaccgacagcaacuucuccgucaagcaggauaucguggccaucacggacuggagcggcuacagcggguccuucguccagcaccccgagcugaccggccucgauugcauccggcccugcuucuggguggagcugauccgcgggcggcccaaggagagcaccaucuggaccuccggcagcuccaucagcuuuugcggcgugaacuccgacacggucagcugguccuggccggacggggccgagcugcccuucaccaucgacaaguga

SEQ ID NO: 23464 - RNA, 1350 nt, Artificial Sequence
  derived and/or modified CDS sequence (AUadapt) from InfluenzaA__AEO89138__NA
augaaucccaaccagaagaucaucaccaucggcucgaucugcauggugaccgggaucgucucccugaugcuccagaucggcaacaucaucagcaugugggugucccacaguauccagacgcgcaaccagcaccaggccgagccgauccggaacaccaacuuccugaccgagaacgccguggcguccgucacccugacggggaacaguucccucugccccauccgcggcugggccgugcacagcaaggacaacuccauccggaucgggagcaagggcgauguguucgucauccgcgagcccuucaucuccugcagccaccuggagugccggaccuucuuucugacccagggcgcccuccugaacgacaagcacuccaacgggaccgugaaggaccgcagcccccaccggacgcugauguccuguccggugggcgaggcccccagccccuacaacucccgcuucgagagcgucgccugguccgcgagcgccugucacgacgggaccagcuggcucaccaucggcaucuccgggcccgacaacggcgccguggccgugcugaaguacaacggcaucaucaccgauacgaucaagagcuggcggaacaacauccugcgcacccaggaguccgagugcgcgugcgucaacgggaguugcuucaccgugaugaccgacggcccguccaacgggcaggccagcuacaagaucuucaagauggagaagggcaagguggucaaguccguggagcucaaugcccccaacuaccacuacgaggagugcagcugcuaucccgacgccggcgagaucaucugcgugugccgggacaacuggcacggguccaaucgccccugggucagcuucaaccagaaccuggaguaccagaucggcuacaucugcuccgggguguuuggcgacaacccgcggcccaacgacgggacgggcagcugcggccccgugucccccaauggggccuacggcaucaagggguucagcuucaaguacggcaacggggucuggaucggccgcaccaaguccaccaacagucgguccggcuucgagaugaucugggacccgaacggguggaccggcacggacaacgacuucagugugaagcaggacaucguggcgaucaccgacugguccggguacagcggcagcuucguccagcaucccgagcugaccgggcucgacugcauccgccccugcuucuggguggagcugauccggggccgccccaaggaguccaccgucuggacgagcggcuccagcaucuccuucuguggggugaacagcgacaccguguccuggagcuggccggacggcgccgagcugcccuucaccaucgacaaguga

SEQ ID NO: 23465 - RNA, 1350 nt, Artificial Sequence
  derived and/or modified CDS sequence (AUadapt) from InfluenzaA__AEO89156__NA
augaaucccaaccagaagaucaucaccaucggcagcaucugcauggugaccgggaucgucucccugaugcuccagaucggcaacaucacgagcaugugggugucccauagcauccagacccgcaaccagcaccaggccgagccgauccggaacaccaacuuccugaccgagaaugccguggcguccgucacgcuggccgggaacagcucccucugccccauccgcggcugggccgugcacagcaaggacaauuccauccggaucgggagcaagggcgacguguucgucauccgcgagcccuucaucuccugcagccaucuggagugccggaccuucuuccugacccagggcgcccuccugaacgacaagcacuccaaugggaccgugaaggaccgcagcccccaccggacgcugauguccugcccggugggcgaggcccccagccccuauaacucccgcuucgagagcgucgcgugguccgccagcgccugccacgaugggaccagcuggcucaccaucggcaucuccgggcccgacaacggcgccguggcggugcugaaguacaacggcaucaucaccgacacgaucaagaguuggcggaacaacauccugcgcacccaggaguccgagugcgccugcgucaacgggagcuguuucaccgugaugaccgacggcccguccaacgggcaggccagcuacaagaucuucaagauggagaagggcaagguggucaaguccguggagcucaaugcccccaacuaccacuacgaggagugcaguugcuaccccgacgccggcgagaucaucugcgugugccgggacaauuggcacggguccaaccgccccugggucagcuucaaccagaaccuggaguaucagaucggcuacaucugcuccgggguguucggcgacaacccgcggcccaacgaugggacgggcagcugcggccccgugucccccaacggggcguacggcaucaagggguucagcuuuaaguacggcaacggggucuggaucggccgcaccaaguccaccaacagccgguccggcuucgagaugaucugggauccgaacggguggaccggcacggacagcgacuucuccgugaagcaggacaucguggccaucaccgauuggagcggguacagcggcuccuucguccagcaccccgagcugaccgggcucgacuguauccgccccugcuucuggguggagcugauccggggccgccccaaggagagcaccaucuggacguccggcagcuccaucagcuucuguggggucaacuccgacaccgugagcugguccuggccggacggcgccgagcugcccuucaccaucgacaaguga

SEQ ID NO: 23466 - RNA, 1350 nt, Artificial Sequence
  derived and/or modified CDS sequence (AUadapt) from InfluenzaA__AEO89174__NA
augaaucccaaccagaagaucaucaccaucggcagcaucugcauggugaccgggaucgucucccugaugcuccagaucggcaacaucaucagcaugugggugucccacaguauccagacgcgcaaccagcaccaggccgagccgauccggaacaccaacuuccugaccgagaacgccguggcguccgucacccuggccgggaauagcucccucugccccauccgcggcugggccgugcacagcaaggacaacuccauccggaucgggaguaagggcgacguguucgucauccgcgagcccuucaucuccugcagccaccuggagugucggacguucuuccugacccagggcgcccuccugaacgacaagcacuccaacgggaccgugaaggaucgcagcccccaccggacccugauguccugcccggugggcgaggcccccagccccuacaacucccgcuuugagagcgucgcgugguccgccagcgccugccacgacgggacgagcuggcucaccaucggcaucuccgggcccgacaauggcgccguggcggugcugaaguacaacggcaucaucaccgacaccaucaagagcuggcggaacaacauccugcgcacgcaggaguccgagugugccugcgucaacgggagcugcuucaccgugaugaccgacggcccguccaaugggcaggccagcuacaagaucuucaagauggagaagggcaagguggucaaguccguggagcucaacgcccccaacuaccauuacgaggagugcagcugcuaccccgacgccggcgagaucaucugugugugccgggacaacuggcacggguccaaccgccccugggucagcuuuaaccagaaccuggaguaccagaucggcuacaucugcuccgggguguucggcgacaauccgcggcccaacgacgggaccggcagcugcggccccgugucccccaacggggcguacggcaucaagggguuuagcuucaaguacggcaacggggucuggaucggccgcacgaaguccaccaacagccgguccggcuuugagaugaucugggacccgaacggguggaccggcaccgacagcgacuucuccgugaagcaggauaucguggccaucacggacuggagcggguacagcggcuccuucguccagcaccccgagcugaccgggcucgauugcauccgccccugcuucuggguggagcugauccggggccgccccaaggagagcaccaucuggaccuccggcagcuccaucagcuuuugcggggucaacuccgacacggugagcugguccuggccggacggcgccgagcugcccuucaccaucgacaaguga

SEQ ID NO: 23467 - RNA, 1350 nt, Artificial Sequence; identical to SEQ ID NO: 16403
  derived and/or modified CDS sequence (AUadapt) from InfluenzaA__AEO89183__NA

SEQ ID NO: 23468 - RNA, 1350 nt, Artificial Sequence
  derived and/or modified CDS sequence (AUadapt) from InfluenzaA__AEO89205__NA
augaaucccacccaaaagaucaucaccaucggcagcaucugcauggugaucgggaucgucucccugaugcuccagaucggcaacaugaucagcaucugggugucccacagcauccagacggggaaucagcaccaggccgagccgauccgcaacgccuccuuccugaccgagaacgcgguggccagcgucacccuggccggcaacuccagucucugccccgugcgggggugggccgugcacuccaaggacaacagcauccgcaucggcuccaagggcgacgucuucgugauccgggagcccuuuaucagcugcucccaccuggagugccgcaccuucuuccugacgcaaggggcccuccugaaugacaagcacagcaacggcaccgugaaggaccggagcccccaccgcacccugaugaguugcccggucggggaggcgcccucccccuacaacagccgguucgaguccguggccuggagcgccagugccugccacgacggcaucuccuggcucaccaucgggaucagcggccccgacaacggcgcgguggccguccugaaguacaaugggaucaucacggacaccaucaaguccuggcgcaacaacauccugcggacccaggagagcgagugcgccugcgugaauggcuccugcuucaccgugaugacggacgggccgagcaacggccaggccuccuacaagaucuucaagauggaaaagggcaaggucgugaaguccguggagcucaaugcccccaacuaccacuacgaggagugcuccugcuaucccgacgcgggggagaucacgugcgucugccgcgacaacuggcacggcaguaaccggcccuggguguccuucaaccagaaccuggaguaccagaucggguacaucugcaguggcguguucggggacaacccgcgccccaacgacggcaccggcuccugcgggcccgucagucccaacggcgccuacgggaucaagggcuucuccuucaaguacgggaacggcguguggaucggccggaccaaaagcaccaauucccgcagcggguucgagaugaucugggacccgaacggcugggccgagaccgacuccaacuuuagcgugaagcaggacaucgucgccaucaccgacuggagcggguacuccggcagcuucgugcagcaucccgagcugaccgggcucgacugcauccggcccugcuucugggucgagcugauccgcggccggcccaaggagggcacgaucuggaccuccgggagcuccaucagcuuuugcggcgugaacuccgacaccgugagcugguccuggccggacggggccgagcugcccuucaccaucgacaaguga

SEQ ID NO: 23469 - RNA, 1350 nt, Artificial Sequence
  derived and/or modified CDS sequence (AUadapt) from InfluenzaA__AEO89215__NA
augaaucccaaccaaaagaucaucaccaucggcagcaucugcauggccaucgggaucgugucccugaugcuccagaucggcaacaugaucagcaucugggucucccacaguauccagaccgggaaccagcaccaggccgagccgauccgcaacgcguccuuccugacggagaacgccguggccagcgugacccuggccggcaauuccagccucugccccguccgggggugggccgugcacuccaaggacaacagcauccgcaucggcuccaagggcgauguguucgucauccgggagcccuucaucagcugcucccaccuggagugccgcaccuuuuuccugacccagggggcgcuccugaacgacaagcacagcaacggcacggugaaggaucggagcccccaccgcacccugauguccugcccggugggggaggcccccucccccuacaacagccgguuugaguccgucgccuggagcgccagcgcgugccacgacggcaucuccuggcucaccaucgggaucagcggccccgauaacggcgccguggccgugcugaaauacaacgggaucaucaccgacacgaucaaguccuggcgcaacaacauccugcggacccaggagagugagugcgccugcgucaacggcuccugcuucaccgugaugaccgacgggccgaguaacggccaggccuccuacaagaucuucaagauggagaagggcaagguggucaagagcguggagcucaacgcgcccaacuaccauuacgaggagugcuccugcuaccccgacgccggggagaucacgugcgugugucgcgacaacuggcacggcagcaaccggcccugggucuccuucaaucagaaccuggaauaccagaucggguacaucugcagcggcguguucggggauaacccgcgccccaacgacggcaccggcuccugcgggcccgugagccccaacggcgccuaugggaucaagggcuucuccuucaaguacgggaacggcgucuggaucggccggaccaagagcaccaacucccgcaguggguucgagaugaucugggacccgaacggcugggccgagacggacuccaacuucagugugaagcaggacaucguggccaucaccgacuggagcggguacuccggcagcuucguccagcaucccgagcugaccgggcucgacugcauccggcccugcuucuggguggagcugauccgcggccggcccaaggagggcaccaucuggacguccgggagcuccaucagcuuuugcggcgucaacuccgacaccgugagcugguccuggccggacggggcggagcugcccuucaccaucgacaaguga

SEQ ID NO: 23470 - RNA, 1350 nt, Artificial Sequence
  derived and/or modified CDS sequence (AUadapt) from InfluenzaA__AEO89226__NA
augaaucccacccaaaagaucaucaccaucggcagcaucugcauggccaucgggaucgugucccugaugcuccagaucggcaacaugaucagcaucugggucucccacagcauccagacggggaaucagcaccaggccgagccgauccgcaacgcguccuuccugaccgagaacgccguggccagcgugacccuggccggcaacuccagucucugccccguccgggggugggccgugcacuccaaggacaacagcauccgcaucggcuccaagggcgacguguuugucauccgggagcccuucaucagcugcucccaccuggagugccgcaccuucuuucugacgcaaggggcgcuccugaacgacaagcacagcaacggcaccgugaaggaccggaguccccaccgcacccugauguccugcccggugggggaggcccccucccccuacaacagccgguucgaguccgucgccuggagugccagcgcgugccacgacggcaucuccuggcucaccaucgggaucagcggccccgacaauggcgccguggccgugcugaaguacaacgggaucaucacggacaccaucaaguccuggcgcaacaacauccugcggacccaggagagcgagugugccugcgucaacggcuccugcuucaccgugaugacggacgggccgagcaauggccaggccuccuacaagaucuucaagauggaaaagggcaagguggucaagagcguggagcucaacgcgcccaacuaccauuacgaggagugcuccugcuaccccgacgccggggagaucacgugcgugugucgcgacaacuggcacggcagcaaccggcccugggucuccuucaaucagaaccuggaguaccagaucggguacaucugcagcggcguguucggggauaacccgcgccccaacgacggcaccggcuccugcgggcccgugagccccaacggcgccuaugggaucaagggcuucuccuucaaguacgggaacggcgucuggaucggccggaccaaaagcaccaacucccgcaguggguucgagaugaucugggacccgaacggcugggccgagaccgacuccaacuucagugugaagcaggacaucguggccaucaccgacuggagcggguacuccggcagcuucguccagcaucccgagcugaccgggcucgacugcauccggcccugcuucuggguggagcugauccgcggccggcccaaggagggcacgaucuggaccuccgggagcuccaucagcuuuugcggcgucaacuccgacaccgugagcugguccuggccggacggggcggagcugcccuucaccaucgacaaguga

SEQ ID NO: 23471 - RNA, 1350 nt, Artificial Sequence
  derived and/or modified CDS sequence (AUadapt) from InfluenzaA__AEO89237__NA
augaaucccaaccagaagaucaucaccaucggcagcaucugcauggugaucgggaucgucucccugaugcuccagaucggcaacaucaucagcaugugggugucccacaguauccagacccgcaaccagcaccaggccgagccgauccggaacacgaacuuccugaccgagaacgccguggcguccgucacccuggccgggaacaguucccucugccccauccgcggcugggccgugcacagcaaggacaacuccauccggaucgggagcaagggcgauguguucgucauccgcgagcccuucaucuccugcagccaccuggagugccggaccuucuuucugacgcagggcgcccuccugaacgacaagcacuccaacgggaccgugaaggaccgcagcccccaucggacccugauguccugcccggugggcgaggcccccagccccuacaacucccgcuucgagagcgucgcgugguccgccagcgccugucacgacgggaccagcuggcucacgaucggcaucuccgggcccgacaacggcgccguggcggugcugaaguacaauggcaucaucaccgacaccaucaagagcuggcggaacaacauccugcgcacccaggaguccgagugcgccugcgucaacgggaguugcuucacggugaugaccgacggcccguccaacgggcaggccagcuacaagaucuucaagauggagaagggcaagguggucaaguccguggagcucaaugcccccaacuaccacuacgaggagugcagcuguuaccccgacgccggcgagaucaucugcgugugccgggacaacuggcacggguccaaucgccccugggucagcuucaaccagaaccuggaguaccagaucggcuacaucuguuccgggguguucggcgacaacccgcggcccaacgacgggaccggcagcugcggccccgugucccccaauggggcguacggcaucaagggguucagcuucaaguacggcaacggggucuggaucggccgcaccaaguccacgaauagccgguccggcuucgagaugaucugggacccgaacggguggaccggcaccgacagcgacuuuuccgugaagcaggacaucguggccaucaccgacuggagcggguacagcggcuccuucguccagcaucccgagcugacggggcucgacugcauccgccccugcuucuggguggagcugauccggggccgccccaaggagagcaccaucuggaccuccggcagcuccaucagcuuuugcggggucaacuccgacaccgugagcugguccuggccggacggcgccgagcugcccuucacgaucgacaaguga

SEQ ID NO: 23472 - RNA, 1350 nt, Artificial Sequence
  derived and/or modified CDS sequence (AUadapt) from InfluenzaA__AEO89248__NA
augaaucccaaccaaaagaucaucaccaucggcagcaucugcauggugaucgggaucgucucccugaugcuccagaucggcaacaucaucagcaucugggugucccacagcuuucagacccgcgugcagcaccaggccgagccgauccggaacacgaacuuccugaccgagaacgccgucgcguccgugacccuggccgggaacagcucccucugccccauccgcggcugggccgugcauagcaaggacaacuccauccggaucgggagcaagggcgacgucuucgugauccgcgagcccuucaucuccuguagccaccuggagugccggaccuucuuccugacgcagggcgcccuccugaacgacaagcacuccaaugggaccgugaaggaccgcagcccccaccggacccugauguccugcccggucggcgaggcccccagccccuacaacucccgcuuugagagcguggcgugguccgccagcgccugccacgacgggaccagcuggcucacgaucggcaucuccgggcccgacaacggcgccguggcgguccugaaguauaacggcaucaucaccgacaccaucaagagcuggcggaacaacauccugcgcacccaggaguccgagugcgccugcgugaaugggagcugcuucacggugaugaccgacggcccguccaacgggcaggccagcuacaagaucuucaagaugaagaagggcaaggucgugaaguccguggagcucaaugcccccaacuaccacuacgaggagugcagcugcuaucccgacgccggcgagaucaucugcgucugccgggacaacuggcacggguccaaccgccccugggugagcuuuaaccagaaccuggaguaccagaucggcuacaucugcuccgggguguucggcgacaauccgcggcccaacgacgggaccggcagcugcggccccgucucccccaacggggcguacggcaucaagggguucagcuuuaaguacggcaacgggguguggaucggccgcaccaaguccacgaacagccgguccggcuucgagaugaucugggacccgaacggguggaccggcaccgauagcgacuucuccaugaagcaggacaucguggccaucaccgacuggagcggguacagcggcuccuuuguccagcaccccgagcugacggggcucgacugcauccgccccugcuucuggguggagcugauccggggccgccccaaggagagcaccaucuggaccuccggcagcuccaucaguuucugcggggucaacuccgacaccgugagcugguccuggccggacggcgccgagcugcccuucacgaucgacaaguga

SEQ ID NO: 23473 - RNA, 1350 nt, Artificial Sequence
  derived and/or modified CDS sequence (AUadapt) from InfluenzaA__AEO89270__NA
augaaucccaaccagaagaucaucaccaucggcagcaucugcauggugaccgggaucgucucccugaugcuccagaucggcaacaucacgagcaugugggugucccauagcauccagacccgcaaccagcaccaggccgagccgauccggaacaccaacuuucugaccgagaacgccguggcguccgucacgcuggccgggaacagcucccucugccccauccgcggcugggccgugcacagcaaggauaacuccauccggaucgggagcaagggcgacguguucgucauccgcgagcccuucaucuccuguagccaccuggagugccggaccuucuuccugacccagggcgcccuccugaacgauaagcacuccaacgggaccgugaaggaccgcagcccccaccggacgcugauguccuguccggugggcgaggcccccagccccuacaacucccgcuucgagagcgucgcgugguccgccagcgccugucacgacgggaccagcuggcucaccaucggcaucuccgggcccgacaacggcgccguggcggugcugaaguauaacggcaucaucaccgacacgaucaagagcuggcggaacaacauccugcgcacccaggaguccgagugcgccugugucaacgggagcugcuucaccgugaugaccgacggcccguccaaugggcaggccagcuacaagaucuucaagauggagaagggcaagguggucaaguccguggagcucaacgcccccaacuaccauuacgaggagugcagcugcuaccccgaugccggcgagaucaucugcgugugccgggacaacuggcacggguccaaccgccccugggucaguuucaaccagaaccuggaguaccagaucggcuacaucuguuccgggguguucggcgacaacccgcggcccaacgacgggacgggcagcuguggccccgugucccccaacggggcguacggcaucaagggguucagcuucaaguauggcaacggggucuggaucggccgcaccaaguccaccaacagccgguccggcuucgagaugaucugggacccgaacggguggaccggcacggauagcgacuucuccgugaagcaggacaucguggccaucaccgacuggaguggguacagcggcuccuucguccagcaccccgagcugaccgggcucgacugcauccgccccuguuucuggguggagcugauccggggccgccccaaggagagcaccaucuggacguccggcagcuccaucagcuucuguggggucaacuccgacaccgugggcuggagcuggccggacggggccgagcugcccuucaccaucgacaaguga

SEQ ID NO: 23474 - RNA, 1350 nt, Artificial Sequence
  derived and/or modified CDS sequence (AUadapt) from InfluenzaA__AEO89281__NA
augaaucccaaccagaagaucaucaccaucggcucgaucugcaugguggucgggaucgugucccugaugcuccagaucggcaacaucgugagcaucugggucucccacaguauccagaccgggcaccagcagcaggccgagccgaucaagaacacgaacuuccugaccaagaacgccguggcguccgugacccuggccggcaacaguucccucugccccauccgcgggugggccguccacagcaaggacaacuccauccggaucggcagcaagggcgacguguuugugauccgcgagcccuucaucuccugcagccaccuggagugccggaccuucuuucugacgcagggggcccuccugaacgacaagcacuccaacggcaccgucaaggaccgcagcccccaccggacccugauguccuguccggugggggaggcccccagccccuacaacucccgcuucgagagcguggcgugguccgccagcgccugucacgacggcaccagcuggcucacgaucgggaucuccggccccgacaacggcgccgucgcggugcugaaguacaacgggaucaucaccgauaccaucaagagcuggcggaacaacacccugcgcacgcaggaguccgagugcgccugcgugaacggcaguugcuucaccgucaugaccgacgggccguccaacggccaggccagcuacaagaucuucaagauggagaagggcaagguggugaaguccgccgagcucaaugcccccaacuaccacuacgaggagugcagcuguuaccccgacgcgggggagaucaucugcgucugccgggacaacuggcauggcuccaaccgccccugggugagcuucaaccagaaccuggaguaccagaucggguacaucuguuccggcguguucggggacaacccgcggcccaacgacggcaccggcagcugugggcccgucucccccaacggcgccuacgggaucaagggcuucagcuucaaguacgggaacggcguguggaucggccgcacgaaguccaccaauagccgguccggguucgagaugaucugggacccgaacggcuggaccgggaccgacagcaauuucuccaugaagcaggacaucguggccaucacggaguggagcggcuacagcggguccuucguccagcaccccgagcugaccggccucgauugcauccgccccugcuucuggguggagcugauccggggccgccccaaggagagcaccaucuggaccuccgggagcuccaucagcuuuugcggcgucaacuccgacacggugagcugguccuggccggacggggccgagcugcccuucaccaucgacaaguga

SEQ ID NO: 23475 - RNA, 1350 nt, Artificial Sequence
  derived and/or modified CDS sequence (AUadapt) from InfluenzaA__AEO89291__NA
augaaucccaaccagaagaucaucaccaucggcucgaucugcaugguggucgggaucgugucccugaugcuccagaucggcaacaucgugagcaucugggucucccacaguauccagaccgggcaccagcagcaggccgagccgaucaagaacacgaacuuccugaccgagaacgccguggcguccgugacccuggccggcaacaguucccucugccccauccgcgggugggccguccacagcaaggacaacuccauccggaucggcagcaagggcgacguguuugugauccgcgagcccuucaucuccugcagccaccuggagugccggaccuucuuucugacgcagggggcccuccugaacgacaagcacuccaacggcaccgucaaggaccgcagcccccaccggacccugauguccuguccggugggggaggcccccagccccuacaacucccgcuucgagagcguggcgugguccgccagcgccugucacgacggcaccagcuggcucacgaucgggaucuccggccccgacaacggcgccgucgcggugcugaaguacaacgggaucaucaccgauaccaucaagagcuggcggaacaacauccugcgcacccaggaguccgagugcgccugcgugaacggcaguugcuucacggucaugaccgacgggccguccaacggccaggccagcuacaagaucuucaagauggagaagggcaagguggugaaguccgccgagcucaaugcccccaacuaccacuacgaggagugcagcuguuaccccgacgcgggggagaucaucugcgucugccgggacaacuggcauggcuccaaccgccccugggugagcuucaaccagaaccuggaguaccagaucggguacaucuguuccggcguguucggggacaacccgcggcccaacgacggcaccggcagcugugggcccgucucccccaacggcgccuacgggaucaagggcuucagcuucaaguacgggaacggcguguggaucggccgcaccaaguccacgaauagccgguccggguucgagaugaucugggacccgaacggcuggaccgggaccgacagcaauuucuccaugaagcaggacaucguggccaucaccgaguggagcggcuacagcggguccuucguccagcaccccgagcugacgggccucgauugcauccgccccugcuucuggguggagcugauccggggccgccccaaggagagcaccaucuggaccuccgggagcuccaucagcuuuugcggcgucaacuccgacaccgugagcugguccuggccggacggggccgagcugcccuucacgaucgacaaguga

SEQ ID NO: 23476 - RNA, 1350 nt, Artificial Sequence
  derived and/or modified CDS sequence (AUadapt) from InfluenzaA__AEO89302__NA
augaaucccaaccaaaagaucaucaccaucggcagcaucugcauggugaucgggaucgucucccugaugcuccagaucggcaacaucaucagcaucugggugucccacaguauccagaccgggaaccagcaccaggacgagccgauccgcaacgccaacuuccugacggagaaugccguggcguccgucacccuggccggcaacagcucccucugccccgugcgggggugggccgugcacagcaaggacaauuccauccgcaucggcagcaagggcgacgucuucgugauccgggagcccuucaucuccugcagccaccuggagugucgcaccuucuuccugacccagggggcccuccugaacgacaagcacuccaacggcacggugaaggaucggagcccccaccgcacccugauguccugcccggucggggaggcccccagccccuacaacucccgguuugagagcguggcgugguccgccagcgccugccacgacggcaccagcuggcucaccaucgggaucuccggccccgauaacggcgccguggcgguccugaaguacaacgggaucaucacggacaccaucaagagcuggcgcaacaacauccugcggacccaggaguccgagugugccugcgugaacggcagcugcuucaccgugaugacggacgggccguccaauggccaggccagcuacaagaucuucaagauggaaaagggcaaggucgugcgcuccguggagcucaacgcccccaacuaccauuacgaggagugcagcugcuaccccgacgccggggagaucacgugugucugccgggacaacuggcacggcuccaaccgccccugggugagcuucaaucagaaccuggaguaccagaucggguacaucugcuccggcguguucggggacaauccgcggcccaacgacggcaccggcagcugcgaccccgucucccccaacggggcguauggcaucaagggguucagcuucaaguacggcaacgggguguggaucggccgcaccaaguccaccaacagucgguccggcuucgagaugaucugggacccgaacggguggaccgagaccgacagcgacuucuccgugaagcaggauaucgucgccaucaccgacuggagcggcuacagcggguccuucgugcagcaccccgagcugacgggccucgauugcauccgccccugcuucugggucgagcugauccgggggcgccccaaggagagcaccaucuggaccuccggcagcuccaucagcuuuugcggcguguccagcgacaccguguccuggagcuggccggacggggccgagcugcccuucacgaucgacaaguga

SEQ ID NO: 23477 - RNA, 1410 nt, Artificial Sequence; identical to SEQ ID NO: 18459
  derived and/or modified CDS sequence (AUadapt) from InfluenzaA__AEO99218__NA

SEQ ID NO: 23478 - RNA, 1410 nt, Artificial Sequence
  derived and/or modified CDS sequence (AUadapt) from InfluenzaA__AEQ49739__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgaggugaccugcgugugccgggacaacuggcacggcagcaaccgccccugggucuccuucaaccagaaccucgaguaccagaucggguacaucugcucgggcaucuucggggacaacccgcggcccaacgacaagacgggcuccugcggccccgugagcuccaacggggccaacggcgugaagggguucagcuucaaguacggcaacggggucuggaucggccgcaccaagagcaucuccagccggaagggcuucgagaugaucugggaccccaacggguggaccggcaccgacaacaacuucuccaucaagcaggacaucguggggaucaacgaguggucgggcuacuccgggagcuucgugcagcacccggagcugacgggcauggacugcauccgccccugcuucugggucgagcugauccggggccgccccaaggagaacaccaucuggaccuccgggagcuccaucagcuucugcggcgugaacuccgacaccgucggguggagcuggcccgacggcgccgagcucccguucacgaucgacaaguga

SEQ ID NO: 23479 - RNA, 1410 nt, Artificial Sequence; identical to SEQ ID NO: 22659
  derived and/or modified CDS sequence (AUadapt) from InfluenzaA__AEQ49740__NA

SEQ ID NO: 23480 - RNA, 1410 nt, Artificial Sequence
  derived and/or modified CDS sequence (AUadapt) from InfluenzaA__AEQ49741__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggucgggcuacuccgggagcuucgugcagcacccggagcugacgggcauggacugcauccgccccugcuucuggguggagcugauccggggccgccccaaggagaacaccaucuggaccuccgggagcuccaucagcuucugcggcgucaacuccgacaccgugggguggagcuggcccgacggcgccgagcucccguucacgaucgacaaguga

SEQ ID NO: 23481 - RNA, 1410 nt, Artificial Sequence
  derived and/or modified CDS sequence (AUadapt) from InfluenzaA__AEQ49742__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccauccacagcaaggacaacuccauccgcaucggcagcaagggggacguguucgugauccgggagcccuucaucuccugcucgccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggucggcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagucgguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucucguccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggucgggcuacuccgggagcuucgugcagcacccggagcugacgggcauggacugcauccgccccugcuucuggguggagcugauccggggccgccccaaggagaacaccaucuggaccuccgggagcuccaucagcuucugcggcgucaacuccgacaccgugggguggagcuggcccgacggcgccgagcucccguucacgaucgacaaguga

SEQ ID NO: 23482 - RNA, 1410 nt, Artificial Sequence
  derived and/or modified CDS sequence (AUadapt) from InfluenzaA__AEQ49743__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcucgccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggucggcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagucgguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucucguccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggacgaacgaguggucgggcuacuccgggagcuucgugcagcacccggagcugaccggccuggacugcauccgccccugcuucuggguggagcucauccggggccgccccaaggagaacaccaucuggaccuccgggagcuccaucagcuucugcggcgucaacuccgacacggugggguggagcuggcccgacggcgccgagcugccguucaccaucgacaacuga

SEQ ID NO: 23483 - RNA, 1410 nt, Artificial Sequence
  derived and/or modified CDS sequence (AUadapt) from InfluenzaA__AEQ49744__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccucgucaacgacaagcacuccaacgggaccaucaaggaccggagccccuaccgcacgcugauguccugcccgaucggcgaggugcccagccccuacaacucgcgguucgaguccguggccuggagcgcguccgccugccacgacgggaucaacuggcugaccaucggcaucagcggccccgacaacggggccgucgccgugcucaaguacaacggcaucaucaccgacaccaucaaguccuggcgcaacaacaucuuccggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccugggucuccuucaaccaggaccuggaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccucgcggaagggcuucgagaugaucugggaccccaacggguggaccggcaccgacaacaacuucuccaucaagcagaacaucguggggaucaacgaguggagcggcuacuccgggagcuucgugcagcacccggagcugacgggccucgacugcauccgccccugcuucugggucgagcugauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 23484 - RNA, 1410 nt, Artificial Sequence; identical to SEQ ID NO: 23480
  derived and/or modified CDS sequence (AUadapt) from InfluenzaA__AEQ49745__NA

SEQ ID NO: 23485 - RNA, 1410 nt, Artificial Sequence; identical to SEQ ID NO: 23480
  derived and/or modified CDS sequence (AUadapt) from InfluenzaA__AEQ49746__NA

SEQ ID NO: 23486 - RNA, 1410 nt, Artificial Sequence; identical to SEQ ID NO: 23480
  derived and/or modified CDS sequence (AUadapt) from InfluenzaA__AEQ49747__NA

SEQ ID NO: 23487 - RNA, 1410 nt, Artificial Sequence; identical to SEQ ID NO: 22659
  derived and/or modified CDS sequence (AUadapt) from InfluenzaA__AEQ49748__NA

SEQ ID NO: 23488 - RNA, 1410 nt, Artificial Sequence; identical to SEQ ID NO: 23480
  derived and/or modified CDS sequence (AUadapt) from InfluenzaA__AEQ49749__NA

SEQ ID NO: 23489 - RNA, 1410 nt, Artificial Sequence
  derived and/or modified CDS sequence (AUadapt) from InfluenzaA__AEQ49750__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaaccacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcucgaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagaacaucagcucccggaagggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 23490 - RNA, 1410 nt, Artificial Sequence
  derived and/or modified CDS sequence (AUadapt) from InfluenzaA__AEQ49751__NA
augaaccccaaccagaagaucaucaccaucggcucggugugcaugaccaucgggauggccaaccugauccuccagaucggcaacaucaucuccaucuggaucagccacuccuuccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaaccacuccaacgggaccaucaaggaccggagccccuaccgcacgcugauguccugcccgaucggcgagguccccagccccuacaacucgcgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccucgcggaagggcuucgagaugaucugggaccccaacggguggaccggcaccgacaacaacuucuccaucaagcaggacaucgucgggaucaacgaguggagcggcuacuccgggagcuucgugcagcacccggagcugacgggcauggacugcauccgccccugcuucuggguggagcugauccggggccgccccaaggagaacaccaucuggaccuccgggagcuccaucagcuucugcggcgucaacuccgacaccgugggguggagcuggcccgacggcgccgagcucccguucacgaucgacaaguga

SEQ ID NO: 23491 - RNA, 1410 nt, Artificial Sequence
  derived and/or modified CDS sequence (AUadapt) from InfluenzaA__AEQ49752__NA
augaaccccaaccagaagaucaucaccaucggcucggugugcaugaccaucgggauggccaaccugauccuccagaucggcaacaucaucuccaucuggaucagccacuccauccagcuggggaaccagagccagaucggcacgugcaaccaguccgucaucaccuacgagaacaacaccugggugaaccagaccuacgugaacaucagcaacacgaacuucgccgcggggcaguccgucgugagcgugaagcuggccggcaacuccucgcucugcccggucuccggcugggccaucuacagcaaggacaacuccauccgcaucgggagcaagggcgacguguucgugauccgggagcccuucaucuccugcagcccccuggagugccgcaccuucuuccugacccagggggcccuccugaacgacaagcacuccaacggcaccaucaaggaccggagccccuaccgcacgcugauguccugcccgaucggggagguccccagccccuacaacucgcgguucgaguccguggccuggagcgcguccgccugccacgacggcaucaacuggcucaccaucggcaucagcgggcccgacaacggcgccguggccguccugaaguacaacgggaucaucaccgacaccaucaaguccuggcgcaacaacauccugcggacgcaggagagcgagugcgcgugcgugaacggcuccugcuucaccaucaugaccgacggcccgagcgacgggcaggccuccuacaagaucuuccgcaucgagaagggcaagaucgucaagagcguggagaugaacgcccccaacuacuacuacgaggagugcuccugcuaccccgacucguccgagaucacgugcgugugccgggacaacuggcacgggagcaaccgccccuggguguccuucaaccagaaccucgaguaccagaucggcuacaucugcagcgggaucuucggcgacaacccgcggcccaacgacaagaccggcuccugcgggcccgucagcuccaacggcgccaacggggugaagggcuucagcuucaaguacgggaacggcguguggaucggccgcaccaagagcaucuccucgcggaagggguucgagaugaucugggaccccaacggcuggaccgggaccgacaacaacuucuccaucaagcaggacaucgucggcaucaacgaguggagcggguacuccggcagcuucgugcagcacccggagcugacgggcauggacugcauccgccccugcuucuggguggagcugauccgggggcgccccaaggagaacaccaucuggaccuccggcagcuccaucagcuucugcggggucaacuccgacaccgugggcuggagcuggcccgacggcgccgagcucccguucacgaucgacaaguga

SEQ ID NO: 23492 - RNA, 1410 nt, Artificial Sequence
  derived and/or modified CDS sequence (AUadapt) from InfluenzaA__AEQ49753__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggucgggcuacuccgggagcuucgugcagcacccggagcugacgggcauggacugcauccgccccugcuucuggguggagcugauccggggccgccccaaggagaacaccaucuggaccuccgggagcuccaucagcuucugcggcgucaacuccgacaccguggacuggagcuggcccgacggggccgagcucccguucacgaucgacaaguga

SEQ ID NO: 23493 - RNA, 1410 nt, Artificial Sequence
  derived and/or modified CDS sequence (AUadapt) from InfluenzaA__AEQ49754__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggucgggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccaacaccgugggguggagcuggcccgacggcgccgagcugccguucacgaucgacaaguga

SEQ ID NO: 23494 - RNA, 1410 nt, Artificial Sequence; identical to SEQ ID NO: 23480
  derived and/or modified CDS sequence (AUadapt) from InfluenzaA__AEQ49755__NA

SEQ ID NO: 23495 - RNA, 1410 nt, Artificial Sequence
  derived and/or modified CDS sequence (AUadapt) from InfluenzaA__AEQ49756__NA
augaaccccaaccagaagaucaucaccaucggcucggugugcaugaccaucgggauggccaaccugauccuccagaucggcaacaucaucuccaucuggaucagccacuccauccagcuggggaaccagagccaggucgagacgugcaaccaguccgugaucaccuacgagaacaacaccugggugaaccagaccuacgucaacaucagcaacacgaacuucgccgcgggccaguccguggugucggucaagcuggccgggaacuccagccucugcccgguguccggcugggccaucuacagcaaggacaacuccauccgcaucggcagcaagggggacguguucgucauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgaggugcccagccccuacaacagccgguucgaguccguggccuggagcgcguccgccugccacgacgggaucaacuggcucaccaucggcaucagcggccccgacaacggggccgucgccgugcugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaagggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 23496 - RNA, 1410 nt, Artificial Sequence; identical to SEQ ID NO: 23480
  derived and/or modified CDS sequence (AUadapt) from InfluenzaA__AEQ49757__NA

SEQ ID NO: 23497 - RNA, 1410 nt, Artificial Sequence
  derived and/or modified CDS sequence (AUadapt) from InfluenzaA__AEQ49758__NA
augaaccccaaccagaagaucaucaccaucggcucggugugcaugaccaucgggauggccaaccugauccuccagaucggcaacaucaucuccaucuggaucagccacuccauccagcuggggaaccacagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucgcgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuacuacuacgaggagugcuccugcuaccccgacucguccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccucgcggaagggcuucgagaugaucugggaccccaacgggugggccggcaccgacaacaacuucuccaucaagcaggacaucgucgggaucaacgaguggagcggcuacuccgggagcuucgugcagcacccggagcugaccggccuggacugcauccgccccugcuucuggguggagcucauccggggccgccccaaggagaacacgaucuggaccuccgggagcuccaucagcuucugcggcgucaacuccgacaccgugggguggagcuggcccgacggcgcggagcugccguucaccaucgacaaguga

SEQ ID NO: 23498 - RNA, 1410 nt, Artificial Sequence; identical to SEQ ID NO: 23480
  derived and/or modified CDS sequence (AUadapt) from InfluenzaA__AEQ49759__NA

SEQ ID NO: 23499 - RNA, 1410 nt, Artificial Sequence; identical to SEQ ID NO: 23480
  derived and/or modified CDS sequence (AUadapt) from InfluenzaA__AEQ49760__NA

SEQ ID NO: 23500 - RNA, 1410 nt, Artificial Sequence
  derived and/or modified CDS sequence (AUadapt) from InfluenzaA__AEQ49761__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccuggcugaaccagaccuacgugaacaucagcaacacgaacuucgccgcgggccaguccguggucagcgugaagcucgccgggaacuccucgcugugcccgguguccggcugggccaucuacagcaaggacaacuccauccgcaucggcagcaagggggacgucuucgugauccgggagcccuucaucuccugcagccccuccgagugccgcaccuucuuccugacccagggcgcccuccugaacgacaagcacagcaacgggaccaucaaggaccggucccccuaccgcacgcugaugucgugcccgaucggcgaggugcccagccccuacaacucccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggucgugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcucgugcggccccguguccagcaacggggccaacggcgucaagggguucagcuucaaguacggcaacgggguguggaucggccgcaccaaguccaucagcucccggaagggcuucgagaugaucugggaccccaacggguggaccggcaccgacaacaacuucagcaucaagcaggacaucguggggaucaacgagugguccggcuacucgggguccuucguccagcacccggagcugacgggccuggacugcauccgccccugcuucuggguggagcucauccggggccgcagcaaggagaacaccaucuggaccuccgggagcuccaucagcuucugcggcgugaacuccgacaccgucggguggagcuggcccgacggcgccgagcugcccuucacgaucgacaaguga

SEQ ID NO: 23501 - RNA, 1410 nt, Artificial Sequence
  derived and/or modified CDS sequence (AUadapt) from InfluenzaA__AEQ49762__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccuggaucaaccagaccuacgugaacaucagcaacacgaacuucgccgcgggccaguccguggucagcgugaagcuggccgggaacuccucgcucugcccgguguccggcugggccaucuacagcaaggacaacuccauccgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacucgcgguucgaguccgucgccuggagcgcguccgccugccacgacgggaucaacuggcucaccaucggcaucagcggccccgacaacggggccguggccgugcugaaguacaacggcaucaucaccgacaccaucaaguccuggcgcaacaacauccugcggacgcaggagagcgagugcgcgugcgucaacggguccugcuucaucaucaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgugagcuccaacggggccaacggcgucaagggguucagcuucaaguacggcaacgggguguggaucggccgcaccaagagcaucuccucgcggaagggcuucgagaugaucugggaccccaacggguggaccggcaccgacaacaacuucuccaucaagcaggacaucguggggaucaacgaguggagcggcuacuccgggagcuucguccagcacccggagcugaccggccuggacugcauccgccccugcuucuggguggagcucauccggggccgccccaaggagaacacgaucuggaccuccgggagcuccaucagcuucugcggcgugaacuccgacaccgucggguggagcuggcccgacggcgccgagcugccguucaccaucgacaaguga

SEQ ID NO: 23502 - RNA, 1410 nt, Artificial Sequence; identical to SEQ ID NO: 23480
  derived and/or modified CDS sequence (AUadapt) from InfluenzaA__AEQ49763__NA

SEQ ID NO: 23503 - RNA, 1410 nt, Artificial Sequence; identical to SEQ ID NO: 23480
  derived and/or modified CDS sequence (AUadapt) from InfluenzaA__AEQ49764__NA

SEQ ID NO: 23504 - RNA, 1410 nt, Artificial Sequence; identical to SEQ ID NO: 23480
  derived and/or modified CDS sequence (AUadapt) from InfluenzaA__AEQ49765__NA

SEQ ID NO: 23505 - RNA, 1410 nt, Artificial Sequence
  derived and/or modified CDS sequence (AUadapt) from InfluenzaA__AEQ49766__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcugaccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggacgaucaaggaccggucgcccuaccgcacccugauguccugcccgaucggcgagguccccagccccuacaacagccgguucgaguccguggccuggagcgccuccgcgugccacgacgggaucaacuggcucaccaucggcaucagcggccccgacaacggggccguggccguccugaaguacaacggcaucaucaccgacacgaucaaguccuggcgcaacaacauccugcggacccaggagucggagugcgccugcgugaacggguccugcuucaccaucaugaccgacggcccgagcgacggccaggcguccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcacggacaacaacuucuccaucaagcaggacaucgucgggaucaacgaguggucgggcuacuccgggagcuucgugcagcacccggagcugaccggccuggacugcauccgccccugcuucuggguggagcucauccggggccgccccaaggagaacaccaucuggaccuccgggagcuccaucagcuucugcggcgucaacuccgacacggugggguggagcuggcccgacggcgccgagcugccguucaccaucgacaaguga

SEQ ID NO: 23506 - RNA, 1410 nt, Artificial Sequence
  derived and/or modified CDS sequence (AUadapt) from InfluenzaA__AEQ49767__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcucgccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggucggcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuucaagaucgagaaggggaagaucgucaagucgguggagaugaacgcccccaacuaccacuacgaggagugcuccugcuaccccgacagcuccgagaucacgugcgugugccgcgacaacuggcacggcagcaaccggcccuggguguccuucaaccagaaccucgaguaccagaucggguacaucugcagcggcaucuucggggacaacccgcgccccaacgacaagaccggcuccugcggccccgucucguccaacggggccaacggcgugaagggguucagcuacaaguacggcaacgggguguggaucggccggaccaagagcaucuccagccgcaagggcuucgagaugaucugggaccccaacggguggaccggcaccgacaacaacuucuccaucaagcaggacaucgucgggaucaacgaguggucgggcuacuccgggagcuucgugcagcacccggagcugacgggcaugggcugcauccggcccugcuucuggguggagcugauccgcgggcggcccaaggagaacaccaucuggaccuccggcagcuccaucagcuucugcggggucaacuccgacaccgugggcuggagcuggcccgacggcgccgagcucccguucacgaucgacaaguga

SEQ ID NO: 23507 - RNA, 1410 nt, Artificial Sequence; identical to SEQ ID NO: 22659
  derived and/or modified CDS sequence (AUadapt) from InfluenzaA__AEQ49768__NA

SEQ ID NO: 23508 - RNA, 1410 nt, Artificial Sequence; identical to SEQ ID NO: 23480
  derived and/or modified CDS sequence (AUadapt) from InfluenzaA__AEQ49769__NA

SEQ ID NO: 23509 - RNA, 1410 nt, Artificial Sequence
  derived and/or modified CDS sequence (AUadapt) from InfluenzaA__AEQ49770__NA
augaaccccaaccagaagaucaucaccaucggcucggugugcaugaccaucgggauggccaaccugauccuccagaucggcaacaucaucuccgucuggaucagccacuccauccagcuggggaaccagaaccagacggagaccugcaaccagagcgugaucaccuacgagaacaacaccugggugaaccagacguacgucaacaucuccaacaccaacuucgccgcgggccagagcgugguguccgucaagcuggccgggaacucgucccucugcccggugagcggcugggccaucuacuccaaggacaacagcauccgcaucggcuccaagggggacguguucgucauccgggagcccuucaucagcugcucgccccuggagugccgcaccuucuuccugacccagggcgcccuccugaacgacaagcacuccaacgggacgaucaaggaccggucccccuaccgcacccugaugagcugcccgaucggcgaggugcccucccccuacaacagccgguucgagagcguggccugguccgcgucggccugccacgacgggaucaacuggcucaccaucggcaucuccggccccgacaacggggccgucgccgugcugaaguacaacggcaucaucaccgacacgaucaagagcuggcgcaacaacauccugcggacccaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccggaucggguacaucugcuccggcaucuucggggacaacccgcgccccaacgacaagaccggcagcugcggccccguguccucgaacggggccaacggcgucaagggguucuccuucaaguacggcaacgggguguggaucggccggaccaagagcaucagcucccgcaacggcuucgagaugaucugggaccccaacggguggaccggcacggacaacaacuucagcaucaagcaggacaucaucgggaucaacgagugguccggcuacucgggguccuucgugcagcacccggagcugaccggccuggacugcauccggcccugcuucugggucgagcucauccgcggccggcccaaggagaacaccaucuggaccagcggguccagcaucuccuucugcggcgugaacagcgacacggucgggugguccuggcccgacggcgccgagcugccguucaccguggacaaguga

SEQ ID NO: 23510 - RNA, 1410 nt, Artificial Sequence; identical to SEQ ID NO: 23493
  derived and/or modified CDS sequence (AUadapt) from InfluenzaA__AEQ49771__NA

SEQ ID NO: 23511 - RNA, 1410 nt, Artificial Sequence; identical to SEQ ID NO: 22659
  derived and/or modified CDS sequence (AUadapt) from InfluenzaA__AEQ49772__NA

SEQ ID NO: 23512 - RNA, 1410 nt, Artificial Sequence
  derived and/or modified CDS sequence (AUadapt) from InfluenzaA__AEQ49773__NA
augaaccccaaccagaagaucaucaccaucggcucgaucugcaugaccaucgggauggccaaccugauccuccagaucggcaacaucaucuccaucuggaucagccacuccauccagcuggggaaccagagccagaucgagacgugcaaccaguccgugaucaccuacgagaacaacaccugggucaaccagaccuacgugaacaucagcaacacgaacuucgccgcgggccaguccguggucucggugaagcuggccgggaacuccagccucugcccgguguccggcugggccaucuacagcaaggacaacuccauccgcaucggcagcaagggggacgucuucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgaggugcccagccccuacaacagccgguucgaguccgucgccuggagcgcguccgccugccacgacgggaucaacuggcucaccaucggcaucagcggccccgacaacggggccguggccgugcugaaguacaacggcaucaucaccgacaccaucaaguccuggcgcaacaacauccugcggacgcaggagucggagugcgcgugcgucaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgugagcuccaacggggccaacggcgucaagggguucagcuucaaguacggcaacgggguguggaucggccgcaccaagagcaucuccagccggaagggcuucgagaugaucugggaccccaacggguggaccggcaccgacaacaacuucuccaucaagcaggacaucguggggaucaacgaguggucgggcuacuccgggagcuucguccagcacccggagcugacgggccuggacugcauccgccccugcuucuggguggagcucauccggggccgccccaaggagaacaccaucuggaccuccgggagcuccaucagcuucugcggcgugaacuccaacaccgucggguggagcuggcccgacggcgccgagcugccguucacgaucgacaaguga

SEQ ID NO: 23513 - RNA, 1410 nt, Artificial Sequence
  derived and/or modified CDS sequence (AUadapt) from InfluenzaA__AEQ49774__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgaguacaacaccugggugaaccagaccuacaucaacaucagcaacacgaacuucgccgcgggccaguccguggucagcgugaagcugguggggaacuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucgcgguucgaguccguggccuggagcgccuccgcgugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgccugcgugaacggguccugcuucaccaucaugaccgacggcccgagcgacggccaggcguccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccucgcggaagggcuacgagaugaucugggaccccaacggguggaccggcaccgacaacaacuucuccaucaagcaggacaucgucgggaucaacgaguggagcggcuacuccgggagcuucgugcagcacccggagcugacgggcauggacugcauccgccccugcuucuggguggagcugauccggggccgccccaaggagaacaccaucuggaccuccgggagcuccaucagcuucugcggcgucaacuccgacaccgugggguggagcuggcccgacggcgccgagcucccguucacgaucgacaaguga

SEQ ID NO: 23514 - RNA, 1410 nt, Artificial Sequence; identical to SEQ ID NO: 22659
  derived and/or modified CDS sequence (AUadapt) from InfluenzaA__AEQ49775__NA

SEQ ID NO: 23515 - RNA, 1410 nt, Artificial Sequence
  derived and/or modified CDS sequence (AUadapt) from InfluenzaA__AEQ49776__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagccccuccgagugccgcaccuucuuccugacccagggcgcccugcucaacgacaagcacucgaacgggaccaucaaggaccggucccccuaccgcacgcugaugagcugcccgaucggcgagguccccagccccuacaacucccgguucgagagcguggccugguccgcgagcgccugccacgacgggaucaacuggcugaccaucggcaucuccggccccgacaacggggccguggccguccucaaguacaacggcaucaucaccgacaccaucaagucguggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccuggaguaccagaucggguacaucugcuccggcaucuucggggacaacccgcggcccaacgacaagaccggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcaccgacaacaacuucucgaucaagcaggacaucgucgggaucaacgagugguccggcuacagcggguccuucgugcagcacccggagcucacgggccuggacugcauccgccccugcuucuggguggagcugauccggggccgccccaccgagaacaccaucuggaccagcggguccagcaucuccuucugcggcgucaacagcgacacgguggggugguccuggcccgacggcgccgagcucccguucaccaucgacaaguga

SEQ ID NO: 23516 - RNA, 1410 nt, Artificial Sequence; identical to SEQ ID NO: 23480
  derived and/or modified CDS sequence (AUadapt) from InfluenzaA__AEQ49777__NA

SEQ ID NO: 23517 - RNA, 1410 nt, Artificial Sequence
  derived and/or modified CDS sequence (AUadapt) from InfluenzaA__AEQ49778__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccuggaucaaccagaccuacgugaacaucagcaacacgaacuucgccgcggugcaguccgucgugagcgugaagcuggccggcaacuccacccucugcccggucucggggugggccaucuacuccaaggacaacagcauccgcaucggcuccaagggcgacguguucgugauccgggagcccuucaucagcugcagcccccuggagugccgcaccuucuuccugacccagggggcccuccugaacgacaagcacuccaacggcacgaucaaggaccggucccccuaccgcacccugaugagcugcccgaucggggagguccccucccccuacaacagccgguucgagucgguggccugguccgcgagcgccugccacgacggcaucaacuggcucaccaucgggaucuccggccccgacaacggcgccguggccguccugaaguacaacgggaucaucaccgacacgaucaagagcuggcgcaacaacauccugcggacccaggaguccgagugcgcgugcgugaacggcagcugcuucaccaucaugaccgacgggccguccgacggccaggccagcuacaagaucuuccgcaucgagaagggcaagaucgugaaguccgucgagaugaacgcccccaacuaccacuacgaggagugcucgugcuaccccgacuccagcgagaucacgugcgugugccgggacaacuggcacggguccaaccgccccugggugagcuucaaccagaaccucgaguaccagaucggcuacaucugcuccgggaucuucggcgacaacccgcggcccaacgacaagaccgggagcugcggccccgucuccagcaacggcgccaacggggugaagggcuucuccuucaaguacgggaacggcguguggaucgggcgcaccaagagcaucucgucccggaagggcuucgagaugaucugggaccccaacggcuggaccgggacggacaacaacuucagcaucaagcaggacaucgucggcaucaacgagugguccggguacagcggcuccuucgugcagcacccggagcugaccgggcuggacugcauccgccccugcuucuggguggagcucauccggggccgccccaaggagaacaccaucuggaccagcggcuccagcaucuccuucugcggggucaacagcgacacggugggcugguccuggcccgacggggccgagcugccguucaccaucgacaaguga

SEQ ID NO: 23518 - RNA, 1410 nt, Artificial Sequence
  derived and/or modified CDS sequence (AUadapt) from InfluenzaA__AEQ49779__NA
augaaccccaaccagaagaucaucaccaucggcucggugugcaugaccaucgggauggccaaccugauccuccagaucggcaacaucaucuccaucuggaucagccacuccauccagcuggggaaccagaaccagacggagaccugcaaccagagcgucaucaccuacgagaacaacaccugggugaaccagacguacgugaacaucuccaacaccaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccggaucggguacaucugcuccggcaucuucggggacaacccgcgccccaacgacaagaccggcagcugcggccccguguccucgaacggggccaacggcgugaagggguucuccuucaaguacggcaacggggucuggaucggccggaccaagagcaucagcucccgcaacggcuucgagaugaucugggaccccaacggguggaccggcacggacaacaacuucagcaucaagcaggacaucaucgggaucaacgagugguccggcuacucgggguccuucgugcagcacccggagcugaccggccuggacugcauccggcccugcuucuggguggagcucauccgcggccggcccaaggagaacaccaucuggaccagcggguccagcaucuccuucugcggcgucaacagcgacacgguggggugguccuggcccgacggcgccgagcugccguucaccgucgacaaguga

SEQ ID NO: 23519 - RNA, 1410 nt, Artificial Sequence; identical to SEQ ID NO: 22659
  derived and/or modified CDS sequence (AUadapt) from InfluenzaA__AEQ49780__NA

SEQ ID NO: 23520 - RNA, 1410 nt, Artificial Sequence; identical to SEQ ID NO: 22659
  derived and/or modified CDS sequence (AUadapt) from InfluenzaA__AEQ49781__NA

SEQ ID NO: 23521 - RNA, 1410 nt, Artificial Sequence; identical to SEQ ID NO: 23480
  derived and/or modified CDS sequence (AUadapt) from InfluenzaA__AEQ49782__NA

SEQ ID NO: 23522 - RNA, 1410 nt, Artificial Sequence
  derived and/or modified CDS sequence (AUadapt) from InfluenzaA__AEQ49783__NA
augaaccccaaccagaagaucaucaccaucggcucggccugcaugaccaucgggauggccaaccugauccuccagaucggcaacaucaucuccaucuggaucagccacuccauccagcuggggaaccagagccagaucgagacgugcaaccaguccgugaucaccuacgagaacaacaccugggucaaccagaccuacgugaacaucagcaacacgaacuucgcggccggccaguccguggucucggugaagcuggccgggaacuccagccucugcccgguguccggcugggccaucuacagcaaggacaacuccauccgcaucggcagcaagggggacgucuucgugauccgggagcccuucaucuccugcucgccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccgucgcguggucggccuccgccugccacgacgggaucaacuggcucaccaucggcaucagcggccccgacaacggggccguggcggugcugaaguacaacggcaucaucaccgacaccaucaaguccuggcgcaacaacauccugcggacgcaggagagcgagugcgccugcgucaacggguccugcuucaccaucaugaccgacggcccgagcgacggccaggccuccuacaagaucuuccgcaucgagaaggggaagaucgucaagucgguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgugucguccaacggggccaacggcgucaagggguucagcuucaaguacggcaacgggguguggaucggccgcaccaagagcaucuccagccggaagggcuucgagaugaucugggaccccaacggguggaccggcaccgacaacaacuucuccaucaagcaggacaucguggggaucaacgaguggucgggcuacuccgggagcuucguccagcacccggagcugacgggccuggacugcauccgccccugcuucuggguggagcucauccggggccgccccaaggagaacaccaucuggaccuccgggagcuccaucagcuucugcggcgugaacuccgacaccgucggguggagcuggcccgacggcgcggagcugccguucacgaucgacaaguga

SEQ ID NO: 23523 - RNA, 1410 nt, Artificial Sequence
  derived and/or modified CDS sequence (AUadapt) from InfluenzaA__AEQ49785__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaugaaggaccacuccaucgucagcuccuacgugugcucgggccuggugggcgacacgccccggaagaacgacuccagcuccucgucccacugcuucgaccccaacgacgaggagggcgggcacggggucaagggcugggccuucgacgacgggaacgacguguggaugggccgcaccaucagcgagaagucccggcucggcuacgagaccuucaaggucaucgagggguggagcaaccccaaguccaagcugcagaucaaccgccaggugaucguggaccggggcgaccgcucgggguacuccggcaucuucagcgucgagggcaagucgugcaucaaccggugcuucuacguggagcugauccgcggguccaaggaggagaccgaggugcucuggaccagcaacuccaucgucguguucugcggcaccagcgggacguacggcaccggguccuggccggacggcgccgacaucaaccugaugcccaucuga

SEQ ID NO: 23524 - RNA, 1410 nt, Artificial Sequence; identical to SEQ ID NO: 23523
  derived and/or modified CDS sequence (AUadapt) from InfluenzaA__AEQ49786__NA

SEQ ID NO: 23525 - RNA, 1410 nt, Artificial Sequence; identical to SEQ ID NO: 23523
  derived and/or modified CDS sequence (AUadapt) from InfluenzaA__AEQ49788__NA

SEQ ID NO: 23526 - RNA, 1410 nt, Artificial Sequence; identical to SEQ ID NO: 23523
  derived and/or modified CDS sequence (AUadapt) from InfluenzaA__AEQ49789__NA

SEQ ID NO: 23527 - RNA, 1410 nt, Artificial Sequence
  derived and/or modified CDS sequence (AUadapt) from InfluenzaA__AEQ49790__NA
augaaccccaaccagaagaucaucaccaucggcucggugucccugaccaucagcacgaucugcuucuucaugcagaucgccauccucaucaccaccgucacccugcacuucaagcaguacgaguucuacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcggccggaccccguaccgcacccugcucaugaacgagcugggcgugcccuuccaccuggggacgaagcaggucugcaucgccuggagcuccucguccugccacgacggcaaggccuggcuccacgugugcaucaccggggacgacaagaacgcgaccgccagcuucaucuacaacggccggcugguggacuccguggucucgugguccaaggagauccugcgcacccaggagagcgagugcgugugcaucaacgggacgugcaccguggucaugaccgacggcuccgccucgggcaaggccgacaccaagauccucuucaucgaggaggggaagaucgugcacacgagcacccuguccggcagcgcgcagcacguggaggagugcuccugcuacccccgguaccccgggguccgcugcgugugccgggacaacuggaagggcucgaaccgcccgaucguggacaucaacaucaaggaccacuccaucgucagcuccuacgugugcucgggccuggugggggacacgccccggaagaacgacuccagcuccucgucccacugccucgaccccaacaacgaggagggcgggcacggcgucaaggggugggccuucgacgacggcaacgacguguggaugggccgcaccaucaacgagaccagccggcugggguacgagaccuucaaggucaucgagggcugguccaaccccaagucgaagcugcagaucaaccgccaggugaucguggaccgggggaaccgcuccggcuacagcgggaucuucuccgucgagggcaagucgugcaucaaccggugcuucuacguggagcucauccgcggccggaaggaggagaccgaggugcuguggaccagcaacuccaucgucguguucugcgggacgagcggcaccuacgggaccggcuccuggccggacggggccgaccugaaccucaugcccaucuga

SEQ ID NO: 23528 - RNA, 1410 nt, Artificial Sequence
  derived and/or modified CDS sequence (AUadapt) from InfluenzaA__AEQ49791__NA
augaaccccaaccagaagaucaucaccaucggcucggugucccugaccaucagcacgaucugcuucuucaugcagaucgccauccucaucaccaccgucacccugcacuucaagcaguacgaguucuacccgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgcccuucucgaaggacaacuccauccgccugagcgccggcggggacaucugggucacccgggagcccuacguguccugcgacccggacaagugcuaccaguucgcccucggccaggggaccacgcugaacaacgugcacucgaacaacaccguccgcaaccggacccccuaccgcacccugcucaugaacgagcugggcgugcccuuccaccugggcacgaagcaggucugcaucgccugguccagcuccucgugccacgacgggaaggccuggcuccacgugugcaucaccggcgacgacaagaacgcgaccgccuccuucaucuacaacgggcggcugguggacagcguggucuccuggucgaaggagauccugcgcacccaggaguccgagugcgugugcaucaacggcacgugcaccguggucaugaccgacgggagcgccuccggcaaggccgacaccaagauccucuucaucgaggagggcaagaucgugcacacgucgacccugagcggguccgcgcagcacguggaggagugcucgugcuacccccgguacccgggcguccgcugcgugugccgggacaacuggaagggguccaaccgccccaucguggacaucaacaucaaggaccacagcaucgucuccucguacgugugcuccggccuggugggcgacacgccccggaagaacgacagcuccucguccagccacugccucgaccccaacaacgaggagggcgggcacggggucaagggcugggccuucgacgacgggaacgacguguggaugggccgcaccaucaacgagaccucccggcugggcuacgagaccuucaaggucaucgagggguggucgaacccgaaguccaagcugcagaucaaccgccaggugaucguggaccggggcaaccgcagcggguacuccggcaucuucucggucgaggggaaguccugcaucaaccggugcuucuacguggagcucauccgcggccggaaggaggagaccgaggugcuguggaccagcaacucgaucgucguguucugcggcacguccgggaccuacggcaccgggagcuggcccgacggcgccgaccugaaccucaugcccaucuga

SEQ ID NO: 23529 - RNA, 1410 nt, Artificial Sequence; identical to SEQ ID NO: 23523
  derived and/or modified CDS sequence (AUadapt) from InfluenzaA__AEQ49792__NA

SEQ ID NO: 23530 - RNA, 1410 nt, Artificial Sequence; identical to SEQ ID NO: 23523
  derived and/or modified CDS sequence (AUadapt) from InfluenzaA__AEQ49793__NA

SEQ ID NO: 23531 - RNA, 1410 nt, Artificial Sequence; identical to SEQ ID NO: 23523
  derived and/or modified CDS sequence (AUadapt) from InfluenzaA__AEQ49794__NA

SEQ ID NO: 23532 - RNA, 1410 nt, Artificial Sequence; identical to SEQ ID NO: 23523
  derived and/or modified CDS sequence (AUadapt) from InfluenzaA__AEQ49795__NA

SEQ ID NO: 23533 - RNA, 1410 nt, Artificial Sequence
  derived and/or modified CDS sequence (AUadapt) from InfluenzaA__AEQ49796__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcggccggaccccguaccgcacccugcucaugaacgagcugggcgugcccuuccaccuggggacgaagcaggucugcaucgccuggagcuccucguccugccacgacggcaaggccuggcuccacgugugcaucaccggggacgacaagaacgcgaccgccagcuucaucuacaacggccggcugguggacuccguggucucgugguccaaggagauccugcgcacccaggagagcgagugcgugugcaucaacgggacgugcaccguggucaugaccgacggcuccgccucgggcaaggccgacaccaagauccucuucaucgaggaggggaagaucgugcacacgagcacccuguccggcucggcgcagcacguggaggagugcuccugcuacccccgguaccccgggguccgcugcgugugccgggacaacuggaagggcagcaaccgcccgaucguggacaucaacaucaaggaccacuccaucgucucguccuacgugugcagcggccuggugggggacacgccccggaagaacgacuccucguccagcucccacugccucgaccccaacaacgaggagggcgggcacggcgucaaggggugggccuucgacgacggcaacgacguguggaugggccgcaccaucaacgagaccucgcggcugggguacgagaccuucaaggucaucgagggcugguccaaccccaagagcaagcugcagaucaaccgccaggugaucguggacaaggggaaccgguccggcuacucggggaucuucuccgucgagggcaagagcugcaucaaccgcugcuucuacguggagcucauccggggccgcaaggaggagaccgaggugcuguggaccucgaacuccaucgucguguucugcgggacgagcggcaccuacgggaccggcuccuggccggacggggccgaccugaaccucaugcccaucuga

SEQ ID NO: 23534 - RNA, 1410 nt, Artificial Sequence; identical to SEQ ID NO: 23523
  derived and/or modified CDS sequence (AUadapt) from InfluenzaA__AEQ49797__NA

SEQ ID NO: 23535 - RNA, 1410 nt, Artificial Sequence; identical to SEQ ID NO: 23523
  derived and/or modified CDS sequence (AUadapt) from InfluenzaA__AEQ49798__NA

SEQ ID NO: 23536 - RNA, 1410 nt, Artificial Sequence; identical to SEQ ID NO: 23523
  derived and/or modified CDS sequence (AUadapt) from InfluenzaA__AEQ49799__NA

SEQ ID NO: 23537 - RNA, 1410 nt, Artificial Sequence; identical to SEQ ID NO: 23523
  derived and/or modified CDS sequence (AUadapt) from InfluenzaA__AEQ49800__NA

SEQ ID NO: 23538 - RNA, 1410 nt, Artificial Sequence; identical to SEQ ID NO: 23523
  derived and/or modified CDS sequence (AUadapt) from InfluenzaA__AEQ49801__NA

SEQ ID NO: 23539 - RNA, 1410 nt, Artificial Sequence; identical to SEQ ID NO: 23523
  derived and/or modified CDS sequence (AUadapt) from InfluenzaA__AEQ49802__NA

SEQ ID NO: 23540 - RNA, 1410 nt, Artificial Sequence
  derived and/or modified CDS sequence (AUadapt) from InfluenzaA__AEQ49803__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccaccucguccagccacugccucgaccccaacaacgaggagggcgggcacggggucaagggcugggccuucgacgacgggaacgacguguggaugggccgcaccaucuccgagaccucgcggcugggcuacgagaccuucaaggucaucgaggggugguccaaccccaagagcaagcugcagaucaaccgccaggugaucguggacaagggcaaccgguccggguacucgggcaucuucuccgucgagggcaagagcugcaucaaccgcugcuucuacguggagcucauccgggggcgcaaggaggagaccgaggugcuguggacgucgaacuccaucgucguguucugcggcaccagcgggaccuacggcaccggguccuggccggacggcgccgaccugaaccucaugacgaucuga

SEQ ID NO: 23541 - RNA, 1410 nt, Artificial Sequence
  derived and/or modified CDS sequence (AUadapt) from InfluenzaA__AEQ49804__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggacauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcgggcacggggucaagggcugggccuucgacgacgggaacgacguguggaugggccgcaccaucaacgagacgucgcggcucggcuacgagaccuucaaggucaucgaggggugguccaaccccaagagcaagcugcagaucaaccgccaggugaucguggaccggggcaaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcccaucuga

SEQ ID NO: 23542 - RNA, 1410 nt, Artificial Sequence
  derived and/or modified CDS sequence (AUadapt) from InfluenzaA__AEQ49805__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcaaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggacauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcgggcacggggucaagggcugggccuucgacgacgggaacgacguguggaugggccgcaccaucaacgagacgucgcggcucggcuacgagaccuucaaggucaucgaggggugguccaaccccaagagcaagcugcagaucaaccgccaggugaucguggaccggggcaaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcccaucuga

SEQ ID NO: 23543 - RNA, 1410 nt, Artificial Sequence
  derived and/or modified CDS sequence (AUadapt) from InfluenzaA__AEQ49806__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccuucagcuccucgcacugccucgaccccaacaacgaggagggcgggcacggggucaagggcugggccuucgacgacgggaacgacguguggaugggccgcaccaucaacgagaccucccggcugggcuacgagaccuucaaggucaucgagggguggagcaaccccaaguccaagcugcagaucaaccgccaggugaucguggaccggggcaaccgcucgggguacuccggcaucuucagcgucgaggggaaguccugcaucaaccggugcuucuacguggagcucauccgcggccggaaggaggagaccgaggugcuguggaccucgaacagcaucgucguguucugcggcacguccgggaccuacggcaccgggagcuggccggacggcgccgaccugaaccucaugcccaucuga

SEQ ID NO: 23544 - RNA, 1410 nt, Artificial Sequence; identical to SEQ ID NO: 21920
  derived and/or modified CDS sequence (AUadapt) from InfluenzaA__AEQ49807__NA

SEQ ID NO: 23545 - RNA, 1410 nt, Artificial Sequence
  derived and/or modified CDS sequence (AUadapt) from InfluenzaA__AEQ49809__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcugcagaucaaccgccaggugaucguggaccggggcaaccgguccggguacucgggcaucuucuccgucgagggcaagagcugcaucaaccgcugcuucuacguggagcucauccgggggcgcaaggaggagaccgaggugcuguggaccucgaacuccaucgucguguucugcggcacgagcgggaccuacggcaccggguccuggccggacggcgccgaccugaaccucaugcccaucuga

SEQ ID NO: 23546 - RNA, 1410 nt, Artificial Sequence; identical to SEQ ID NO: 23545
  derived and/or modified CDS sequence (AUadapt) from InfluenzaA__AEQ49811__NA

SEQ ID NO: 23547 - RNA, 1410 nt, Artificial Sequence; identical to SEQ ID NO: 21920
  derived and/or modified CDS sequence (AUadapt) from InfluenzaA__AEQ49812__NA

SEQ ID NO: 23548 - RNA, 1410 nt, Artificial Sequence; identical to SEQ ID NO: 21920
  derived and/or modified CDS sequence (AUadapt) from InfluenzaA__AEQ49813__NA

SEQ ID NO: 23549 - RNA, 1410 nt, Artificial Sequence; identical to SEQ ID NO: 21920
  derived and/or modified CDS sequence (AUadapt) from InfluenzaA__AEQ49815__NA

SEQ ID NO: 23550 - RNA, 1410 nt, Artificial Sequence
  derived and/or modified CDS sequence (AUadapt) from InfluenzaA__AEQ49816__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucagcugguccaaggagauccugcgcacccaggagucggagugcgugugcaucaacggcacgugcaccguggucaugaccgacggguccgccagcggcaaggccgacaccaagauccucuucguggaggagggcaagaucgugcacacgucgacccuguccgggagcgcgcagcacgucgaggagugcuccugcuacccccgguaccccggcgugcgcugcgugugccgggacaacuggaaggggucgaaccgcccgaucgucgacaucaacaugaaggaccacuccaucgugagcuccuacgugugcucgggccuggucggcgacacgccccggaagaacgacuccagcuccagcucccacugcuucgaccccaacgacgaggagggcgggcacggggugaagggcugggccuucgacgacgggaacgacgucuggaugggccgcaccaucucggagaagucccggcucggcuacgagaccuucaaggugaucgagggguggagcaaccccaaguccaagcugcagaucaaccgccaggugaucgucgaccggggcaaccgcucgggguacuccggcaucuucagcguggagggcaagucgugcaucaaccggugcuucuacguggagcugauccgcgggcggaaggaggagaccgagguccucuggaccuccaacagcaucgugguguucugcggcaccuccgggacguacggcaccgggagcuggccggacggcgccgacaucaaccugaugcccaucuga

SEQ ID NO: 23551 - RNA, 1410 nt, Artificial Sequence; identical to SEQ ID NO: 23285
  derived and/or modified CDS sequence (AUadapt) from InfluenzaA__AEQ49820__NA

SEQ ID NO: 23552 - RNA, 1410 nt, Artificial Sequence; identical to SEQ ID NO: 23285
  derived and/or modified CDS sequence (AUadapt) from InfluenzaA__AEQ49821__NA

SEQ ID NO: 23553 - RNA, 1410 nt, Artificial Sequence; identical to SEQ ID NO: 23523
  derived and/or modified CDS sequence (AUadapt) from InfluenzaA__AEQ49822__NA

SEQ ID NO: 23554 - RNA, 1410 nt, Artificial Sequence; identical to SEQ ID NO: 23523
  derived and/or modified CDS sequence (AUadapt) from InfluenzaA__AEQ49823__NA

SEQ ID NO: 23555 - RNA, 1410 nt, Artificial Sequence; identical to SEQ ID NO: 23523
  derived and/or modified CDS sequence (AUadapt) from InfluenzaA__AEQ49824__NA

SEQ ID NO: 23556 - RNA, 1410 nt, Artificial Sequence; identical to SEQ ID NO: 23523
  derived and/or modified CDS sequence (AUadapt) from InfluenzaA__AEQ49825__NA

SEQ ID NO: 23557 - RNA, 1410 nt, Artificial Sequence; identical to SEQ ID NO: 23523
  derived and/or modified CDS sequence (AUadapt) from InfluenzaA__AEQ49826__NA

SEQ ID NO: 23558 - RNA, 1410 nt, Artificial Sequence; identical to SEQ ID NO: 23523
  derived and/or modified CDS sequence (AUadapt) from InfluenzaA__AEQ49827__NA

SEQ ID NO: 23559 - RNA, 1410 nt, Artificial Sequence; identical to SEQ ID NO: 23523
  derived and/or modified CDS sequence (AUadapt) from InfluenzaA__AEQ49828__NA

SEQ ID NO: 23560 - RNA, 1410 nt, Artificial Sequence
  derived and/or modified CDS sequence (AUadapt) from InfluenzaA__AEQ49829__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacccaggagagcgagugcgugugcaucaacggcacgugcaccguggucaugaccgacggguccgcccucggcaaggccgacaccaagauccuguucaucgaggagggcaagaucgugcacacgucgacccugagcggguccgcgcagcacguggaggagugcucgugcuacccccgguaccccggcguccgcugcgugugccgggacaacuggaagggguccaaccgcccgaucguggacaucaacaugaaggaccacagcaucgucuccagcuacgugugcuccggccucgugggcgacacgccccggaagaacgacucguccagcuccucgcacugcuucgaccccaacgacgaggagggcgggcacggggucaagggcugggccuucgacgacgggaacgacguguggaugggccgcaccaucuccgagaagucccggcugggcuacgagaccuucaaggucaucgagggguggagcaaccccaagagcaagcugcagaucaaccgccaggugaucguggaccggggcgaccgcuccggguacucgggcaucuucuccgucgagggcaagagcugcaucaaccggugcuucuacguggagcucauccgcgggucgaaggaggagaccgaggugcuguggaccuccaacagcaucgucguguucugcggcaccuccgggacguacggcaccgggagcuggccggacggcgccgacaucaaccugaugcccaucuga

SEQ ID NO: 23561 - RNA, 1410 nt, Artificial Sequence; identical to SEQ ID NO: 23523
  derived and/or modified CDS sequence (AUadapt) from InfluenzaA__AEQ49830__NA

SEQ ID NO: 23562 - RNA, 1410 nt, Artificial Sequence; identical to SEQ ID NO: 23523
  derived and/or modified CDS sequence (AUadapt) from InfluenzaA__AEQ49831__NA

SEQ ID NO: 23563 - RNA, 1410 nt, Artificial Sequence
  derived and/or modified CDS sequence (AUadapt) from InfluenzaA__AEQ49832__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaugaaggaccacuccaucgucagcuccuacgugugcucgggccuggugggcgacacgccccggaagaacgacuccagcuccucgucccacugcuucgaccccaacgacgaggagggcgggcacggggucaagggcugggccuucgacgacgggaacgacguguggaugggccgcaccaucagcgagaagucccggcucggcuacgagaccuucaaggucguggagggguggagcaaccccaaguccaagcugcagaucaaccgccaggugaucgucgaccggggcgaccgcucgggguacuccggcaucuucagcguggagggcaagucgugcaucaaccggugcuucuacguggagcugauccgcggguccaaggaggagaccgagguccucuggaccagcaacuccaucgugguguucugcggcaccagcgggacguacggcaccggguccuggccggacggcgccgacaucaaccugaugcccaucuga

SEQ ID NO: 23564 - RNA, 1410 nt, Artificial Sequence
  derived and/or modified CDS sequence (AUadapt) from InfluenzaA__AEQ49833__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcugcagaucucccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcacguccgggaccuacggcaccgggagcuggccggacggcgccgaccugaaccucaugcccaucuga

SEQ ID NO: 23565 - RNA, 1410 nt, Artificial Sequence
  derived and/or modified CDS sequence (AUadapt) from InfluenzaA__AEQ49835__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcauggccuggagcuccucguccugccacgacgggaaggccuggcuccacgugugcaucaccggcgacgacaagaacgcgaccgccagcuucaucuacaacgggcggcugguggacuccguggucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaugaaggaccacuccaucgucagcuccuacgugugcucgggccuggugggcgacacgccccggaagaacgacuccagcuccagcucccacugcuucgaccccaacgacgaggagggcgggcacggggucaagggcugggccuucgacgacgggaacgacguguggaugggccgcaccaucucggagaagucccggcucggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcugauccgcgggcggaaggaggagaccgaggugcucuggaccuccaacagcaucgucguguucugcggcaccuccgggacguacggcaccgggagcuggccggacggcgccgacaucaaccugaugcccaucuga

SEQ ID NO: 23566 - RNA, 1410 nt, Artificial Sequence; identical to SEQ ID NO: 23565
  derived and/or modified CDS sequence (AUadapt) from InfluenzaA__AEQ49836__NA

SEQ ID NO: 23567 - RNA, 1410 nt, Artificial Sequence; identical to SEQ ID NO: 23565
  derived and/or modified CDS sequence (AUadapt) from InfluenzaA__AEQ49838__NA

SEQ ID NO: 23568 - RNA, 1410 nt, Artificial Sequence; identical to SEQ ID NO: 23565
  derived and/or modified CDS sequence (AUadapt) from InfluenzaA__AEQ49839__NA

SEQ ID NO: 23569 - RNA, 1410 nt, Artificial Sequence
  derived and/or modified CDS sequence (AUadapt) from InfluenzaA__AEQ49840__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcauggccuggagcuccucguccugccacgacgggaaggccuggcuccacgugugcaucaccggcgacgacaagaacgcgaccgccagcuucaucuacaacgggcggcugguggacuccguggucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaugaaggaccacuccaucgucagcuccuacgugugcucgggccuggugggcgacacgccccggaagaacgacuccagcuccagcucccacugcuucgaccccaacgacgaggagggcgggcacggggucaagggcugggccuucgacgacgggaacgacguguggaugggccgcaccaucucggagaagucccggcucggcuacgagaccuucaaggucaucgagggguggagcaaccacaaguccaagcugcagaucaaccgccaggugaucguggaccggggcaaccgcucgggguacuccggcaucuucagcgucgagggcaagucgugcaucaaccggugcuucuacguggagcugauccgcgggcggaaggaggagaccgaggugcucuggaccuccaacagcaucgucguguucugcggcaccuccgggacguacggcaccgggagcuggcccgacggcgccgacaucaaccugaugccgaucuga

SEQ ID NO: 23570 - RNA, 1410 nt, Artificial Sequence; identical to SEQ ID NO: 23565
  derived and/or modified CDS sequence (AUadapt) from InfluenzaA__AEQ49841__NA

SEQ ID NO: 23571 - RNA, 1410 nt, Artificial Sequence; identical to SEQ ID NO: 23565
  derived and/or modified CDS sequence (AUadapt) from InfluenzaA__AEQ49842__NA

SEQ ID NO: 23572 - RNA, 1410 nt, Artificial Sequence; identical to SEQ ID NO: 23565
  derived and/or modified CDS sequence (AUadapt) from InfluenzaA__AEQ49843__NA

SEQ ID NO: 23573 - RNA, 1410 nt, Artificial Sequence; identical to SEQ ID NO: 23523
  derived and/or modified CDS sequence (AUadapt) from InfluenzaA__AEQ49844__NA

SEQ ID NO: 23574 - RNA, 1410 nt, Artificial Sequence
  derived and/or modified CDS sequence (AUadapt) from InfluenzaA__AEQ49845__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagcgggagaucugccccaagcuggccgaguaccgcaacuggucgaagccgcagugcgacaucaccggguucgcgcccuucuccaaggacaacagcauccggcuguccgccggcggggacaucugggucacccgcgagcccuacgugucgugcgaccccaacaagugcuaccaguucgcccucggccaggggaccacgcugaacaacgugcacuccaacaacaccguccgggaccgcaccccguaccggacccugcucaugaacgagcugggcgugcccuuccaccugggcacgaagcaggucugcauggccuggagcuccucguccugccacgacgggaaggccuggcuccacgugugcaucaccggcgacgacaagaacgcgaccgccagcuucaucuacaacgggcgccugguggacuccguggucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaugaaggaccacuccaucgucagcuccuacgugugcucgggccuggugggcgacacgccccgcaagaacgacuccagcuccagcucccacugcuucgaccccaacgacgaggagggcgggcacggggucaagggcugggccuucgacgacgggaacgacguguggaugggccggaccaucucggagaagucccgccucggcuacgagaccuucaaggucaucgagggguggagcaaccccaaguccaagcugcagaucaaccgccaggugaucguggaccggggcaaccggucgggguacuccggcaucuucagcgucgagggcaagucgugcaucaaccgcugcuucuacguggagcugauccgggggcgcaaggaggagaccgaggugcucuggaccuccaacagcaucgucguguucugcggcaccuccgggacguacggcaccgggagcuggccggacggcgccgacaucaaccugaugcccaucuga

SEQ ID NO: 23575 - RNA, 1410 nt, Artificial Sequence
  derived and/or modified CDS sequence (AUadapt) from InfluenzaA__AEQ49846__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcauggccuggagcuccucguccugccacgacgggaaggccuggcuccacgugugcaucaccggcgacgacaagaacgcgaccgccagcuucaucuacaacgggcggcugguggacuccguggucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaaccugaaggaccacuccaucgucagcuccuacgugugcucgggccucgugggcgacacgccccggaagaacgacuccagcuccagcucccacugcuucgaccccaacgacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 23576 - RNA, 1410 nt, Artificial Sequence
  derived and/or modified CDS sequence (AUadapt) from InfluenzaA__AEQ49850__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaugaaggaccacuccaucgucagcuccuacgugugcucgggccuggugggcgacacgccccggaagaacgacuccagcuccucgucccacugcuucgaccccaacgacgaggagggcgggcacggggucaagggcugggccuucgacgacgggaacgacguguggaugggccgcaccaucagcgagaagucccggcucggcuacgagaccuucaaggucaucgagggguggagcaaccccaaguccaagcugcagaucaaccgccaggugaucguggaccggggcgaccgcucgggguacuccggcaucuucagcgucgagggcaagucgugcaucaaccggugcuucuacguggagcugauccgcggguccaaggaggagaccgaggugcucuggaccagcaacuccaucgucguguucugcggcaccagcgggacguacggcaccggguccuggccggacggcgccgacaucaagaucaugcccaucuga

SEQ ID NO: 23577 - RNA, 1410 nt, Artificial Sequence
  derived and/or modified CDS sequence (AUadapt) from InfluenzaA__AEQ49851__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucauggagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcugcagaucaaccgccaggugaucguggaccggggcaaccgguccggguacucgggcaucuucuccgucgagggcaagagcugcaucaaccgcugcuucuacguggagcucauccgggggcgcaaggaggagaccgaggugcuguggaccucgaacuccaucgucguguucugcggcacgagcgggaccuacggcaccggguccuggccggacggcgccgaccugaaccucaugcccaucuga

SEQ ID NO: 23578 - RNA, 1410 nt, Artificial Sequence; identical to SEQ ID NO: 23545
  derived and/or modified CDS sequence (AUadapt) from InfluenzaA__AEQ49852__NA

SEQ ID NO: 23579 - RNA, 1410 nt, Artificial Sequence; identical to SEQ ID NO: 23523
  derived and/or modified CDS sequence (AUadapt) from InfluenzaA__AEQ49969__NA

SEQ ID NO: 23580 - RNA, 1410 nt, Artificial Sequence; identical to SEQ ID NO: 23545
  derived and/or modified CDS sequence (AUadapt) from InfluenzaA__AEQ49970__NA

SEQ ID NO: 23581 - RNA, 1410 nt, Artificial Sequence
  derived and/or modified CDS sequence (AUadapt) from InfluenzaA__AEQ54954__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucucggagaccucccgccugggcuacgagaccuucaaggucaucgagggguggagcaaccccaaguccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcacguccgggaccuacggcaccgggagcuggccggacggcgccgaccugaaccucaugcccaucuga

SEQ ID NO: 23582 - RNA, 1410 nt, Artificial Sequence; identical to SEQ ID NO: 19001
  derived and/or modified CDS sequence (AUadapt) from InfluenzaA__AER08645__NA

SEQ ID NO: 23583 - RNA, 1410 nt, Artificial Sequence
  derived and/or modified CDS sequence (AUadapt) from InfluenzaA__AER08649__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagcuggugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccucgugggcgacacgccccggaagaacgacuccucguccagcucccacugccuggaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcuccagaucaaccgccaggugaucguggaccggggcaaccgcucgggguacuccggcaucuucagcgucgagggcaagucgugcaucaaccggugcuucuacguggagcugauccgcgggcggaaggaggagaccgaggugcuguggaccuccaacagcaucgucguguucugcggcaccuccgggacguacggcaccgggagcuggccggacggcgccgacaucaaccucaugcccaucuga

SEQ ID NO: 23584 - RNA, 1410 nt, Artificial Sequence
  derived and/or modified CDS sequence (AUadapt) from InfluenzaA__AER08657__NA
augaaccccaaccagaagaucaucaccaucggcucggugucccugaccaucagcacggucugcuucuucaugcagaucgccauccucaucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaugugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccgucgugucgugguccaaggagauccugcgcacccaggagagcgagugcgugugcaucaacggcacgugcaccgucgugaugaccgacggguccgccucgggcaaggccgacaccaagauccucuucaucgaggagggcaagaucgugcacacgagcacccuguccgggucggcgcagcacgucgaggagugcuccugcuacccccgguaccccggcgugcgcugcgugugccgggacaacuggaaggggagcaaccgcccgaucgucgacaucaacaucaaggaccacuccaucgugucguccuacgugugcagcggccuggucggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggugaucgucgaccggggcaaccgcucgggguacuccggcaucuucagcguggagggcaagucgugcaucaaccggugcuucuacguggagcucauccgcgggcggaaggaggagaccgagguccuguggaccuccaacagcaucgugguguucugcggcaccuccgggacguacggcaccgggagcuggccggacggcgccgacaucaaccugaugcccaucuga

SEQ ID NO: 23585 - RNA, 1410 nt, Artificial Sequence; identical to SEQ ID NO: 19001
  derived and/or modified CDS sequence (AUadapt) from InfluenzaA__AER08659__NA

SEQ ID NO: 23586 - RNA, 1410 nt, Artificial Sequence
  derived and/or modified CDS sequence (AUadapt) from InfluenzaA__AER08661__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggggaccacggcgucaaggggugggccuucgacgacggcaacgacguguggauggggcgcaccaucaacgagaccucgcggcugggcuacgagaccuucaaggucaucgagggcugguccaaccccaagagcaagcugcagaucaaccgccaggugaucguggaccgggggaaccgcuccggcuacucggggaucuucuccgucgagggcaagagcugcaucaaccggugcuucuacguggagcucauccgcgggcggaaggaggagaccgaggugcuguggaccucgaacuccaucgucguguucugcggcacgagcggcaccuacgggaccggcuccuggccggacggggccgaccugaaccucaugcccaucuga

SEQ ID NO: 23587 - RNA, 1410 nt, Artificial Sequence; identical to SEQ ID NO: 21920
  derived and/or modified CDS sequence (AUadapt) from InfluenzaA__AER08663__NA

SEQ ID NO: 23588 - RNA, 1410 nt, Artificial Sequence; identical to SEQ ID NO: 21920
  derived and/or modified CDS sequence (AUadapt) from InfluenzaA__AER08665__NA

SEQ ID NO: 23589 - RNA, 1410 nt, Artificial Sequence
  derived and/or modified CDS sequence (AUadapt) from InfluenzaA__AER08669__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccacccuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacgcaggagagcgagugcgugugcaucaacgggaccugcaccguggucaugaccgacggguccgccucgggcaaggccgacacgaagauccucuucaucgaggagggcaagaucgugcacaccagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcggccacggggucaagggcugggccuucgacgacgggaacgacguguggaugggccgcaccaucucggagaccucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggacguccaacagcaucgucguguucugcggcaccuccgggaccuacggcaccgggagcuggccggacggcgccgaccugaaccucaugcccaucuga

SEQ ID NO: 23590 - RNA, 1410 nt, Artificial Sequence
  derived and/or modified CDS sequence (AUadapt) from InfluenzaA__AER08671__NA
augaaccccaaccagaagaucaucaccaucggcucggugucccugaccaucagcacgaucugcuucuucaugcagaucgccauccucaucaccaccgucacccugcacuucaagcaguacggguucaacuccccgcccaacaaccaggugaugcugugcgagcccacgaucaucgagcgcaacaucaccgagaucguguaccucaccaacaccacgaucgagaaggagaucugccccacccuggccgaguaccggaacuggucgaagccgcagugcgacaucaccggcuucgcgcccuucuccaaggacaacagcauccgccuguccgccgggggcgacaucugggucacccgggagcccuacgugucgugcgaccccgacaagugcuaccaguucgcccucgggcagggcacgacccugaacaacgugcacuccaacaacaccguccgcgaccggaccccguaccgcacgcugcucaugaacgagcugggcgugcccuuccaccuggggaccaagcaggucugcaucgccuggagcuccucguccugccacgacggcaaggccuggcuccacgugugcaucaccggggacgacaagaacgcgaccgccagcuucaucuacaacggccggcugguggacuccguggucucgugguccaaggagauccugcgcacgcaggagagcgagugcgugugcaucaacgggaccugcaccguggucaugaccgacggcuccgccucgggcaaggccgacacgaagauccucuucaucgaggaggggaagaucgugcacaccagcacccuguccggcucggcgcagcacguggaggagugcuccugcuacccccgguaccccgggguccgcugcgugugccgggacaacuggaagggcagcaaccgcccgaucguggacaucaacaucaaggaccacuccaucgucucguccuacgugugcagcggccuggugggggacacgccccggaagaacgacuccucguccagcucccacugccucgaccccaacaacgaggagggcgggcacggcgucaaggggugggccuucgacgacggcaacgacguguggaugggccgcaccaucaacgagaccucgcggcugggguacgagaccuucaaggucaucgagggcugguccaaccccaagagcaagcugcagaucaaccgccaggugaucguggaccgggggaaccgcuccggcuacucggggaucuucuccgucgagggcaagagcugcaucaaccggugcuucuacguggagcucauccgcggccggaaggaggagaccgaggugcuguggacgucgaacuccaucgucguguucugcgggaccagcggcaccuacgggaccggcuccuggccggacggggccgaccugaaccucaugcccaucuga

SEQ ID NO: 23591 - RNA, 1410 nt, Artificial Sequence; identical to SEQ ID NO: 21920
  derived and/or modified CDS sequence (AUadapt) from InfluenzaA__AER08673__NA

SEQ ID NO: 23592 - RNA, 1410 nt, Artificial Sequence; identical to SEQ ID NO: 21920
  derived and/or modified CDS sequence (AUadapt) from InfluenzaA__AER08675__NA

SEQ ID NO: 23593 - RNA, 1410 nt, Artificial Sequence; identical to SEQ ID NO: 21920
  derived and/or modified CDS sequence (AUadapt) from InfluenzaA__AER08677__NA

SEQ ID NO: 23594 - RNA, 1410 nt, Artificial Sequence; identical to SEQ ID NO: 21920
  derived and/or modified CDS sequence (AUadapt) from InfluenzaA__AER08679__NA

SEQ ID NO: 23595 - RNA, 1410 nt, Artificial Sequence
  derived and/or modified CDS sequence (AUadapt) from InfluenzaA__AER08681__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacgacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggacaagggcaaccgguccggguacucgggcaucuucuccgucgagggcaagagcugcaucaaccgcugcuucuacguggagcucauccgggggcgcaaggaggagaccgaggugcuguggaccucgaacuccaucgucguguucugcggcacgagcgggaccuacggcaccggguccuggccggacggcgccgaccugaaccucaugcccaucuga

SEQ ID NO: 23596 - RNA, 1410 nt, Artificial Sequence; identical to SEQ ID NO: 21920
  derived and/or modified CDS sequence (AUadapt) from InfluenzaA__AER08683__NA

SEQ ID NO: 23597 - RNA, 1410 nt, Artificial Sequence; identical to SEQ ID NO: 23545
  derived and/or modified CDS sequence (AUadapt) from InfluenzaA__AER08685__NA

SEQ ID NO: 23598 - RNA, 1410 nt, Artificial Sequence; identical to SEQ ID NO: 23545
  derived and/or modified CDS sequence (AUadapt) from InfluenzaA__AER08687__NA

SEQ ID NO: 23599 - RNA, 1410 nt, Artificial Sequence
  derived and/or modified CDS sequence (AUadapt) from InfluenzaA__AER08689__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugacgcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacgcaggagucggagugcgugugcaucaacgggaccugcaccguggucaugaccgacggguccgccagcggcaaggccgacacgaagauccucuucaucgaggagggcaagaucgugcacaccucgacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaaggacgacuccucguccagcucccacugccucgaccccaacaacgaggagggcggccacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggaccggggcaaccgcuccggguacucgggcaucuucuccgucgagggcaagagcugcaucaaccggugcuucuacguggagcucauccgcgggcggaaggaggagaccgaggugcuguggacgucgaacuccaucgucguguucugcggcaccagcgggaccuacggcaccggguccuggccggacggcgccgaccugaaccucaugcccaucuga

SEQ ID NO: 23600 - RNA, 1410 nt, Artificial Sequence; identical to SEQ ID NO: 23545
  derived and/or modified CDS sequence (AUadapt) from InfluenzaA__AER08691__NA

SEQ ID NO: 23601 - RNA, 1410 nt, Artificial Sequence
  derived and/or modified CDS sequence (AUadapt) from InfluenzaA__AER08693__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaagaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcugcagaucaaccgccaggugaucguggaccggggcaaccgguccggguacucgggcaucuucuccgucgagggcaagagcugcaucaaccgcugcuucuacguggagcucauccgggggcgcaaggaggagaccgaggugcuguggaccucgaacuccaucgucguguucugcggcacgagcgggaccuacggcaccggguccuggccggacggcgccgaccugaaccucaugcccaucuga

SEQ ID NO: 23602 - RNA, 1410 nt, Artificial Sequence
  derived and/or modified CDS sequence (AUadapt) from InfluenzaA__AER08697__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaccugccccacccuggccgaguaccggaacuggucgaagccgcagugcgacaucaccggguucgcgcccuucuccaaggacaacagcauccgccuguccgccggcggggacaucugggucacgcgggagcccuacgugucgugcgaccccgacaagugcuaccaguucgcccucggccaggggaccacccugaacaacgugcacuccaacaacaccguccgcgaccggacgccguaccgcacccugcucaugaacgagcugggcgugcccuuccaccugggcaccaagcaggucugcaucgccuggagcuccucguccugccacgacgggaaggccuggcuccacgugugcaucaccggcgacgacaagaacgcgacggccagcuucaucuacaacgggcggcugguggacuccguggucucgugguccaaggagauccugcgcacccaggagagcgagugcgugugcaucaacgggaccugcaccguggucaugacggacggguccgccucgggcaaggccgacaccaagauccucuucaucgaggagggcaagaucgugcacaccagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcggccacggggucaagggcugggccuucgacgacgggaacgacguguggaugggccgcaccaucaacgucaccucgcggcugggcuacgagaccuucaaggugaucgaggggugguccaaccccaagagcaagcugcagaucaaccgccaggugaucgucgaccggggcaaccgcuccggguacucgggcaucuucuccguggagggcaagagcugcaucaaccggugcuucuacguggagcucauccgcgggcggaaggaggagacggagguccuguggaccucgaacuccaucgugguguucugcggcaccagcgggaccuacggcacgggguccuggccggacggcgccgaccugaaccucaugcccaucuga

SEQ ID NO: 23603 - RNA, 1410 nt, Artificial Sequence; identical to SEQ ID NO: 23399
  derived and/or modified CDS sequence (AUadapt) from InfluenzaA__AER92714__NA

SEQ ID NO: 23604 - RNA, 1410 nt, Artificial Sequence; identical to SEQ ID NO: 16318
  derived and/or modified CDS sequence (AUadapt) from InfluenzaA__AER92721__NA

SEQ ID NO: 23605 - RNA, 1410 nt, Artificial Sequence; identical to SEQ ID NO: 16318
  derived and/or modified CDS sequence (AUadapt) from InfluenzaA__AER92724__NA

SEQ ID NO: 23606 - RNA, 1413 nt, Artificial Sequence
  derived and/or modified CDS sequence (AUadapt) from InfluenzaA__AET84165__NA
augaaccccaaccagaagaucaucaccaucggcucgaucuccaucgccaucgggaucaucagccugaugcuccagaucggcaacaucaucuccaucugggccagccacuccauccagaccgggucgcagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucucgggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacagcaaguucgaguccguggccuggucggccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacaaggccgccuccuacaagaucuucaagaucgagaaggggaaggugaccaagagcaucgagcucuccgcccccaacuucuacuacgaggagugcagcugcuacccggacaccggcaucgucaugugcgugugccgggacaacuggcacggguccaaccgccccugggugucguucaaccagaaccuggacuaccagaucggcuacaucugcuccggcgucuucggggacaacccccggcccgaggacggcgaggggagcugcaacccggugaccaucgacggcgcgaacggggugaagggcuucuccuacaaguacggcaacggggucuggaucggccgcaccaagagcaaccggcugcgcaagggguucgagaugaucugggaccccaacggcuggacgaacaccgacuccgacuucucggugaagcaggacguggucgccaucaccgacuggagcggguacuccggcagcuucgugcagcaccccgagcucacgggccuggacugcauccggcccugcuucuggguggagcugguccgcgggcucccgcgggagaacaccaccaucuggaccuccggcucguccaucagcuucugcggggugaacuccgacacggccaacuggagcuggcccgacggcgccgagcugcccuucaccaucgacaaguga

SEQ ID NO: 23607 - RNA, 1413 nt, Artificial Sequence; identical to SEQ ID NO: 21332
  derived and/or modified CDS sequence (AUadapt) from InfluenzaA__AET84176__NA

SEQ ID NO: 23608 - RNA, 1413 nt, Artificial Sequence
  derived and/or modified CDS sequence (AUadapt) from InfluenzaA__AET84187__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcauggacuggcucaccaucggcaucagcgggcccgacaacggcgcgguggccguccugaaguacaacgggaucaucacgggcaccaucaaguccuggaagaagcagauccugcgcacccaggagucggagugcgugugcaugaacggcuccugcuucaccaucaugacggacgggcccagcaacaaggccgccuccuacaagaucuucaagaucgagaagggcaaggugaccaagagcaucgagcucaacgcccccaacuucuacuacgaggagugcuccugcuacccggacaccgggaucgucaugugcgugugccgggacaacuggcacggcucgaaccgccccuggguguccuucaaccagaaccuggacuaccagaucggguacaucugcagcggcgucuucggcgacaacccccggcccaaggacggggagggcuccugcaacccggugaccaucgacggggcgaacggcgugaagggguucagcuacaaguacggcaacggcgucuggaucgggcgcacgaaguccaaccggcugcgcaagggcuucgagaugaucugggaccccaacggguggaccaacaccgacucggacuucuccgugaagcaggacguggucgccaucaccgacuggagcggcuacagcggguccuucgugcagcaccccgagcucacgggccuggacugcauccggcccugcuucuggguggagcugguccgcggccucccgcgggagaacaccaccaucuggaccucgggguccagcaucuccuucugcggcgugaacagcgacacggccaacugguccuggcccgacggggccgagcugcccuucaccaucgacaaguga

SEQ ID NO: 23609 - RNA, 1413 nt, Artificial Sequence
  derived and/or modified CDS sequence (AUadapt) from InfluenzaA__AET84198__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcaugacccuggccggcaacuccucgcugugcuccaucagcggcugggccaucuacaccaaggacaacuccauccggaucgggagcaagggcgacgucuucgugauccgcgagccguucaucuccugcucgcaccucgagugccggacguucuuccugacccagggggcccugcucaacgacaagcacuccaacggcaccgugaaggaccgcagccccuaccgggcccugauguccugcccccugggggaggcgcccagcccguacaacucgaaguucgaguccgucgccuggagcgccuccgccugccacgacggcaugggcuggcucaccaucgggaucagcggccccgacaacggggcgguggccgugcugaaguacaacggcaucaucacgggcaccaucaaguccuggaagaagcagauccugcgcacccaggagucggagugcgucugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgugaugugcgucugccgggacaacuggcacgggucgaaccgccccuggguguccuucaaccagaaccuggacuaccagaucggcuacaucugcagcggcguguucggggacaacccccggcccaaggacggcgagggguccugcaacccggucaccguggacggcgcgaacggggugaagggcuucagcuacaaguacggcaacggggucuggaucggccgcacgaaguccaaccggcugcgcaagggguucgagaugaucugggaccccaacggcuggaccaacaccgacucggacuucuccgugaagcaggacguggucgccaucaccgacuggagcggguacagcggcuccuucgugcagcaccccgagcucacgggccuggacugcauccggcccugcuucuggguggagcugguccgcgggcucccgcgggagaacaccaccaucuggaccucgggcuccagcaucuccuucugcggggugaacagcgacacggccaacugguccuggcccgacggcgccgagcugcccuucaccaucgacaaguga

SEQ ID NO: 23610 - RNA, 1413 nt, Artificial Sequence
  derived and/or modified CDS sequence (AUadapt) from InfluenzaA__AET84209__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaaggugguggcgggggaggacaagaccagcgucacccuggccggcaacuccucgcugugcuccaucagcggcugggccaucaacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccaaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacucggacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccucgggcuccagcaucuccuucugcggggucaacagcgacacggccaacugguccuggcccgacggcgccgagcugcccuucaccaucgacaaguga

SEQ ID NO: 23611 - RNA, 1413 nt, Artificial Sequence
  derived and/or modified CDS sequence (AUadapt) from InfluenzaA__AET84231__NA
augaaccccaaccagaagaucaucaccaucggcucgaucuccaucgccaucgggaucaucagccugaugcuccagaucggcuccaucaucagcaucugggccucccacucgauccacaccgggucccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacagcucccugugcucgaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugucgugcccccugggggaggcgcccagcccguacaacuccaaguucgagagcguggccugguccgccucggccugccacgacggcaugggcuggcucaccaucgggaucuccggccccgacaacggggcgguggccguccugaaguacaacggcaucaucacgggcaccaucaagagcuggaagaagcagauccugcgcacccaggaguccgagugcgugugcaugaacgggagcugcuucaccaucaugacggacggccccuccaacaaggccucguccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgccaacggggucaagggcuucucguacaaguacggcaacgggguguggaucggccgcacgaaguccaaccggcugcgcaagggguucgagaugaucugggaccccaacggcuggaccaacaccgacagcgacuucagcgugaagcaggacgucguggcgaucaccgacugguccggguacucgggcuccuucgugcagcaccccgagcucacgggccuggacugcauccggcccugcuucugggucgagcuggugcgcgggcucccgcgggagaacaccaccaucuggaccagcggcuccagcaucuccuucugcggggucaacagcgacacggccaacugguccuggcccgacggcgccgagcugcccuucaccaucgacaaguga

SEQ ID NO: 23612 - RNA, 1413 nt, Artificial Sequence; identical to SEQ ID NO: 19863
  derived and/or modified CDS sequence (AUadapt) from InfluenzaA__AET84242__NA

SEQ ID NO: 23613 - RNA, 1413 nt, Artificial Sequence
  derived and/or modified CDS sequence (AUadapt) from InfluenzaA__AET84253__NA
augaaccccaaccagaagaucaucaccaucggcucgaucuccaucgccaucgggaucaucagccugaugcuccagaucggcuccaucaucagcaucugggccucccacucgauccagaccgggucccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacagcucccugugcucgaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacggagaccaucaagagcuggaagaagcagauccugcgcacccaggaguccgagugcgugugcaugaacggcucgugcuucaccaucaugacggacgggcccuccaacaaggccgccagcuacaagaucuucaagaucgagaagggcaaggugaccaaguccaucgagcucaacgcccccaacuucuacuacgaggagugcagcugcuacccggacaccgggaucgucaugugcgugugccgggacaacuggcacggcuccaaccgccccugggugucguucaaccagaaccuggacuaccagaucggguacaucugcuccggcgucuucggcgacaacccccggcccgaggacggggagggcagcugcaacccggugaccguggacggggcgaacggcgucaagggguucuccuacaaguacggcaacggcguguggaucgggcgcaccaagagcaaccggcugcgcaagggcuucgagaugaucugggaccccaacggguggacgaacaccgacuccgacuucucggugaagcaggacgucguggccaucaccgacuggagcggcuacuccgggagcuucgugcagcaccccgagcucacgggccuggacugcauccggcccugcuucugggucgagcuggugcgcggccucccgcgggagaacaccaccaucuggaccuccgggucguccaucagcuucugcggcgucaacuccgacacggccaacuggagcuggcccgacggggccgagcugcccuucaccaucgacaaguga

SEQ ID NO: 23614 - RNA, 1413 nt, Artificial Sequence
  derived and/or modified CDS sequence (AUadapt) from InfluenzaA__AET84264__NA
augaaccccaaccagaagaucaucaccaucggcucgaucuccaucgccaucgggaucaucagccugauguuccagaucggcuccaucaucagcaucugggccucccacucgauccagaccgggucccagaacaacacgggcaucugcaaccagcgcaucaucaccuacgagaacagcaccugggugaaccacaccuacgucaacaucaacaacacgaacgugguggcgggggaggacaagaccuccgucacccucgccggcaacagcucccugugcucgaucuccggcugggccaucuacaccaaggacaacagcauccggaucggguccaagggcgacguguucgugauccgcgagccguucaucagcugcucccaccuggagugccggacguucuuccucacccagggggcccugcugaacgacaagcacagcaacggcaccgucaaggaccgcucccccuaccgggcccucaugucgugcccccugggggaggcgcccagcccguacaacuccaaguucgagagcguggccugguccgccucggccugccacgacggcaugggcuggcugaccaucgggaucuccggccccgacaacggggcgguggccguccucaaguacaacggcaucaucacggagaccaucaagagcuggaagaagcagauccugcgcacccaggaguccgagugcgugugcaugaacggcagcugcuucaccaucaugacggacgggcccuccaacaaggccgccucguacaagaucuucaagaucgagaagggcaaggugaccaaguccaucgagcugaacgcccccaacuucuacuacgaggagugcagcugcuacccggacaccgggaucgucaugugcgugugccgggacaacuggcacggcuccaaccgccccugggugagcuucaaccagaaccucgacuaccagaucggguacaucugcuccggcgucuucggcgacaacccccggcccgaggacggggagggcagcugcaacccggugaccguggacggggcgaacggcgucaagggguucuccuacaaguacggcaacggcguguggaucgggcgcaccaagucgaaccggcugcgcaagggcuucgagaugaucugggaccccaacggguggacgaacaccgacuccgacuucagcgugaagcaggacgucguggccaucaccgacuggagcggcuacuccgggucguucgugcagcaccccgagcugacgggccucgacugcauccggcccugcuucugggucgagcuggugcgcggccugccgcgggagaacaccaccaucuggaccuccgggagcuccaucagcuucugcggcgucaacuccgacacggccaacuggagcuggcccgacggggccgagcuccccuucaccaucgacaaguga

SEQ ID NO: 23615 - RNA, 1413 nt, Artificial Sequence
  derived and/or modified CDS sequence (AUadapt) from InfluenzaA__AET84275__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggucgaaccgccccuggguguccuucaaccagaaccuggacuaccagaucggcuacaucugcagcggcgucuucggggacaacccccggcccaaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacucggacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccucgggcuccagcaucuccuucugcggggucaacagcgacacggccaacugguccuggcccgacggcgccgagcugcccuucaccaucgacaaguga

SEQ ID NO: 23616 - RNA, 1413 nt, Artificial Sequence; identical to SEQ ID NO: 19863
  derived and/or modified CDS sequence (AUadapt) from InfluenzaA__AET84286__NA

SEQ ID NO: 23617 - RNA, 1413 nt, Artificial Sequence
  derived and/or modified CDS sequence (AUadapt) from InfluenzaA__AET84297__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggucgaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacgacaacggcguguggaucgggcgcacgaaguccaaccggcugcgcaagggcuucgagaugaucugggaccccaacggguggaccaacaccgacucggacuucuccgugaagcaggacgucguggccaucaccgacuggagcggcuacagcggguccuucgugcagcaccccgagcucacgggccuggacugcauccggcccugcuucugggucgagcuggugcgcggccucccgcgggagaacaccaccaucuggaccucgggguccagcaucuccuucugcggcgucaacagcgacacgaccaacugguccuggcccgacggggccgagcugcccuucaccaucgacaaguga

SEQ ID NO: 23618 - RNA, 1413 nt, Artificial Sequence
  derived and/or modified CDS sequence (AUadapt) from InfluenzaA__AET84308__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacggagaccaucaaguccuggaagaagcagauccugcgcacccaggagagcgagugcgugugcaugaacggcuccugcuucaccaucaugacggacgggcccucgaacaaggccgccuccuacaagaucuucaagaucgagaagggcaaggugaccaagagcaucgagcucaacgcccccaacuuccacuacgaggagugcuccugcuacccggacaccgggaucgucaugugcgugugccgggacaacuggcacggcagcaaccgccccuggguguccuucaaccagaaccuggacuaccagaucggguacaucugcucgggcgucuucggcgacaacccccggcccgaggacggggagggcuccugcaacccggugaccguggacggggcgaacggcgucaagggguucagcuacaaguacgacaacggcguguggaucggccgcacgaaguccaaccggcugcgcaagggguucgagaugaucugggaccccaacggcuggaccaacaccgacucggacuucuccgugaagcaggacgucguggccaucaccgacuggagcggguacagcggcuccuucgugcagcaccccgagcucacggggcuggacugcauccggcccugcuucugggucgagcuggugcgcggccucccgcgggagaacaccaccaucuggaccucgggcuccagcaucuccuucugcggggucaacagcgacacgaccaacugguccuggcccgacggcgccgagcugcccuucaccaucgacaaguga

SEQ ID NO: 23619 - RNA, 1413 nt, Artificial Sequence
  derived and/or modified CDS sequence (AUadapt) from InfluenzaA__AET84319__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcaugacccuggccggcaacuccucgcugugcuccaucagcggcugggccaucuacaccaaggacaacuccauccggaucgggagcaagggcgacgucuucgugauccgcgagccguucaucuccugcucgcaccucgagugccggacguucuuccugacccagggggcccugcucaacgacaagcacuccaaccgcaccgugaaggaccggagccccuaccgcgcccugauguccugcccccugggcgaggcgcccagcccguacaacucgaaguucgaguccgucgccuggagcgccuccgccugccacgacgggaugggcuggcucaccaucggcaucagcgggcccgacaacggcgcgguggccgugcugaaguacaacgggaucaucacggagaccaucaaguccuggaagaagcagauccugcggacccaggagucggagugcgucugcaugaacggcuccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgugaugugcgucugccgcgacaacuggcacgggucgaaccggcccuggguguccuucaaccagaaccuggacuaccagaucggcuacaucugcagcgggguguucggcgacaacccccgccccgaggacggcgagggguccugcaacccggucaccguggacggcgcgaacggggugaagggcuucagcuacaaguacgggaacggcgucuggaucggccggacgaaguccaaccgccugcggaagggguucgagaugaucugggaccccaacggcuggaccaacaccgacucggacuucuccgugaagcaggacguggucgccaucaccgacuggagcggguacagcggcuccuucgugcagcaccccgagcucacggggcuggacugcauccgccccugcuucuggguggagcugguccggggccucccgcgcgagaacaccaccaucuggaccucgggcuccagcaucuccuucugcggggugaacagcgacacggccaacugguccuggcccgacggcgccgagcugcccuucaccaucgacaaguga

SEQ ID NO: 23620 - RNA, 1413 nt, Artificial Sequence
  derived and/or modified CDS sequence (AUadapt) from InfluenzaA__AET84330__NA
augaaccccaaccagcgcaucaucaccaucggcucgaucuccaucgccaucgggaucaucagccugaugcuccagaucggcaacaucaucuccaucugggccucgcacuccauccagaucgggagccagaacaacaccggcaucugcaaccagcggaucaucacguacgagaacuccaccugggugaaccacaccuacgucaacaucaacaacaccaacgugguggcgggggaggacaagacgagcgucacccuggccggcaacuccucgcugugcuccaucagcggcugggccaucuacaccaaggacaacuccauccgcaucgggagcaagggcgacguguucgugauccgggagccguucaucuccugcucgcaccucgagugccgcaccuucuuccugacgcagggggcccugcucaacgacaagcacuccaacggcaccgccaaggaccggagccccuaccgcgcgcugauguccugcccccugggggaggcccccagcccguacaacucgaaguucgaguccgucgccuggagcgccuccgcgugccacgacggcaugggcuggcucaccaucgggaucagcggccccgacaacggggccguggccgugcugaaguacaacggcaucaucaccggcacgaucaaguccuggaagaagcagauccugcggacccaggagucggagugcgucugcaugaacggguccugcuucaccaucaugaccgacggccccagcaacaaggccgccuccuacaagaucuucaagaucgagaaggggaaggugaccaagagcaucgagcucaacgcgcccaacuucuacuacgaggagugcuccugcuacccggacacgggcaucgugaugugcgucugccgcgacaacuggcacgggucgaaccggcccuggguguccuucaaccagaaccuggacuaccagaucggcuacaucugcagcggcguguucggggacaacccccgccccaaggacggcgagggguccugcaacccggucaccguggacggcgccaacggggugaagggcuucagcuacaaguacggcaacggggucuggaucggccggaccaaguccaaccgccugcggaagggguucgagaugaucugggaccccaacggcuggacgaacaccgacucggacuucuccgugaagcaggacguggucgccaucaccgacuggagcggguacagcggcuccuucgugcagcaccccgagcucaccggccuggacugcauccgccccugcuucuggguggagcugguccgggggcucccgcgcgagaacacgaccaucuggaccucgggcuccagcaucuccuucugcggggugaacagcgacaccgccaacugguccuggcccgacggcgccgagcugcccuucacgaucgacaaguga

SEQ ID NO: 23621 - RNA, 1413 nt, Artificial Sequence
  derived and/or modified CDS sequence (AUadapt) from InfluenzaA__AET84341__NA
augaaccccaaccagcgcaucaucaccaucggcucgaucuccaucgccaucgggaucaucagccugaugcuccagaucggcaacaucaucuccaucugggccucgcacuccauccagaucgggagccagaacaacaccggcaucugcaaccagcggaucaucacguacgagaacuccaccugggugaaccacaccuacgucaacaucaacaacaccaacgugguggcgggggaggacaagacgagcgucacccuggccggcaacuccucgcugugcuccaucagcggcugggccaucuacaccaaggacaacuccauccgcaucgggagcaagggcgacguguucgugauccgggagccguucaucuccugcucgcaccucgagugccgcaccuucuuccugacgcagggggcccugcucaacgacaagcacuccaacggcaccgccaaggaccggagccccuaccgcgcgcugauguccugcccccugggggaggcccccagcccguacaacucgaaguucgaguccgucgccuggagcgccuccgcgugccacgacggcaugggcuggcucaccaucgggaucagcggccccgacaacggggccguggccgugcugaaguacaacggcaucaucaccggcacgaucaaguccuggaagaagcagauccugcggacccaggagucggagugcgucugcaugaacggguccugcuucaccaucaugaccgacggccccagcaacaaggccgccuccuacaagaucuucaagaucgagaaggggaaggugaccaagagcaucgagcucaacgcgcccaacuucuacuacgaggagugcuccugcuacccggacacgggcaucgugaugugcgucugccgcgacaacuggcacgggucgaaccggcccuggguguccuucaaccagaaccuggacuaccagaucggcuacaucugcagcggcguguucggggacaacccccgccccaaggacggcgagggguccugcaacccggucaccguggacggcgccaacggggugaagggcuucagcuacaaguacggcaacggggucuggaucggccggaccaaguccaaccgccugcggaagggguucgagaugaucugggaccccaacggcuggacgaacaccgacucggacuucuccgugaagcaggacguggucgccaucaccgacuggagcggguacagcggcuccuucgugcagcaccccgagcucaccggccuggacugcauccgccccugcuucuggguggagcugguccgggggcucccgaaggagaacacgaccaucuggaccucgggcuccagcaucuccuucugcggggugaacagcgacaccgccaacugguccuggcccgacggcgccgagcugcccuucacgaucgacaaguga

SEQ ID NO: 23622 - RNA, 1413 nt, Artificial Sequence
  derived and/or modified CDS sequence (AUadapt) from InfluenzaA__AET84363__NA
augaaccccaaccagcgcaucaucaccaucggcucgaucuccaucgccaucgggaucaucagccugaugcuccagaucggcaacaucaucuccaucugggccucgcacuccauccagaccgggagccagaacaacacgggcaucugcaaccagcggaucaucaccuacgagaacuccaccugggugaaccacaccuacgucaacaucaacaacacgaacgugguggcgggggaggacaagaccagcaugacccuggccggcaacuccucgcugugcuccaucagcggcugggccaucuacaccaaggacaacuccauccgcaucgggucgaagggcgacgucuucgugauccgggagccguucaucuccugcagccaccucgagugccgcacguucuuccugacccagggggcccugcucaacgacaagcacuccaacggcaccgccaaggaccggagccccuaccgcgcgcugauguccugcccccugggggaggcccccucgccguacaacagcaaguucgaguccguggccuggagcgccuccgcgugccacgacggcaugggcuggcucaccaucgggaucucgggccccgacaacggggccgucgccgugcugaaguacaacggcaucaucacgggcaccaucaaguccuggaagaagcagauccugcggacccaggagagcgagugcgugugcaugaacggguccugcuucaccaucaugacggacggccccucgaacaaggccgccuccuacaagaucuucaagaucgagaaggggaaggucaccaagagcaucgagcucaacgcgcccaacuucuacuacgaggagugcuccugcuacccggacaccggcaucgugaugugcgugugccgcgacaacuggcacgggagcaaccggcccugggucuccuucaaccagaaccuggacuaccagaucggcuacaucugcucgggcguguucggggacaacccccgccccaaggacggcgagggguccugcaacccggugaccgucgacggcgccaacggggugaagggcuucagcuacaaguacggcaacgggguguggaucggccggacgaaguccaaccgccugcggaagggguucgagaugaucugggaccccaacggcuggaccaacaccgacucggacuucuccgucaagcaggacgugguggccaucaccgacuggagcggguacagcggcuccuucguccagcaccccgagcucacgggccuggacugcauccgccccugcuucuggguggagcuggugcgggggcucccgcgcgagaacaccaccaucuggaccucgggcuccagcaucuccuucugcggggucaacagcgacacggccaacugguccuggcccgacggcgccgagcugcccuucaccaucgacaaguga

SEQ ID NO: 23623 - RNA, 1413 nt, Artificial Sequence
  derived and/or modified CDS sequence (AUadapt) from InfluenzaA__AET84374__NA
augaaccccaaccagcgcaucaucaccaucggcucgaucuccaucgccaucgggaucaucagccugaugcuccagaucggcaacaucaucuccaucugggccucgcacuccauccagaucgggagccagaacaacaccggcaucugcaaccagcggaucaucacguacgagaacuccaccugggugaaccacaccuacgucaacaucaacaacaccaacgugguggcgggggaggacaagacgagcgucacccuggccggcaacuccucgcugugcuccaucagcggcugggccaucuacaccaaggacaacuccauccgcaucgggagcaagggcgacguguucgugauccgggagccguucaucuccugcucgcaccucgagugccgcaccuucuuccugacgcagggggcccugcucaacgacaagcacuccaacggcaccgccaaggaccggagccccuaccgcgcgcugauguccugcccccugggggaggcccccagcccguacaacucgaaguucgaguccgucgccuggagcgccuccgcgugccacgacggcaugggcuggcucaccaucgggaucagcggccccgacaacggggccguggccgugcugaaguacaacggcaucaucaccgagacgaucaaguccuggaagaagcagauccugcggacccaggagucggagugcgucugcaugaacggcuccugcuucaccaucaugaccgacgggcccagcaacaaggccgccuccuacaagaucuucaagaucgagaagggcaaggugaccaagagcaucgagcucaacgcgcccaacuucuacuacgaggagugcuccugcuacccggacacggggaucgugaugugcgucugccgcgacaacuggcacggcucgaaccggcccuggguguccuucaaccagaaccuggacuaccagaucggguacaucugcagcggcguguucggcgacaacccccgccccaaggacggggagggcuccugcaacccggucaccguggacggggccaacggcgugaagggguucagcuacaaguacggcaacggcgucuggaucgggcggaccaaguccaaccgccugcggaagggcuucgagaugaucugggaccccaacggguggacgaacaccgacucggacuucuccgugaagcaggacguggucgccaucaccgacuggagcggcuacagcggguccuucgugcagcaccccgagcucaccggccuggacugcauccgccccugcuucuggguggagcugguccggggccucccgcgcgagaacacgaccaucuggaccucgggguccagcaucuccuucugcggcgugaacagcgacaccgccaacugguccuggcccgacggggccgagcugcccuucacgaucgacaaguga

SEQ ID NO: 23624 - RNA, 1413 nt, Artificial Sequence
  derived and/or modified CDS sequence (AUadapt) from InfluenzaA__AET84396__NA
augaaccccaaccagcgcaucaucaccaucggcucgaucuccaucgccaucgggaucaucagccugaugcuccagaucggcaacaucaucuccaucugggccucgcacuccauccagaccgggagccagaacaacacgggcaucugcaaccagcggaucaucaccuacgagaacuccaccugggugaaccacaccuacgucaacaucaacaacacgaacgugguggcgggggaggacaagaccagcaugacccuggccggcaacuccucgcugugcuccaucagcggcugggccaucuacaccaaggacaacuccauccgcaucgggucgaagggcgacgucuucgugauccgggagccguucaucuccugcagccaccucgagugccgcacguucuuccugacccagggggcccugcucaacgacaagcacuccaacggcaccgccaaggaccggagccccuaccgcgcgcugauguccugcccccugggggaggcccccucgccguacaacagcaaguucgaguccguggccuggagcgccuccgcgugccacgacggcaugggcuggcucaccaucgggaucucgggccccgacaacggggccgucgccgugcugaaguacaacggcaucaucacggagaccaucaaguccuggaagaagcagauccugcggacccaggagagcgagugcgugugcaugaacggcuccugcuucaccaucaugacggacgggcccucgaacaaggccgccuccuacaagaucuucaagaucgagaagggcaaggucaccaagagcaucgagcucaacgcgcccaacuucuacuacgaggagugcuccugcuacccggacaccgggaucgugaugugcgugugccgcgacaacuggcacggcagcaaccggcccugggucuccuucaaccagaaccuggacuaccagaucggguacaucugcucgggcguguucggcgacaacccccgccccaaggacggggagggcuccugcaacccggugaccgucgacggggccaacggcgugaagggguucagcuacaaguacggcaacggcguguggaucgggcggacgaaguccaaccgccugcggaagggcuucgagaugaucugggaccccaacggguggaccaacaccgacucggacuucuccgucaagcaggacgugguggccaucaccgacuggagcggcuacagcggguccuucguccagcaccccgagcucacgggccuggacugcauccgccccugcuucuggguggagcuggugcggggccucccgcgcgagaacaccaccaucuggaccucgggguccagcaucuccuucugcggcgucaacagcgacacggccaacugguccuggcccgacggggccgagcugcccuucaccaucgacaaguga

SEQ ID NO: 23625 - RNA, 1413 nt, Artificial Sequence
  derived and/or modified CDS sequence (AUadapt) from InfluenzaA__AET84407__NA
augaaccccaaccagcgcaucaucaccaucggcucgaucuccaucgccaucgggaucaucagccugaugcuccagaucggcaacaucaucuccaucugggccucgcacuccauccagaucgggagccagaacaacaccggcaucugcaaccagcggaucaucacguacgagaacuccaccugggugaaccacaccuacgucaacaucaacaacaccaacgugguggcgggggaggacaagacgagcgucacccuggccggcaacuccucgcugugcuccaucagcggcugggccaucuacaccaaggacaacuccauccgcaucgggagcaagggcgacguguucgugauccgggagccguucaucuccugcucgcaccucgagugccgcaccuucuuccugacgcagggggcccugcucaacgacaagcacuccaacggcaccgccaaggaccggagccccuaccgcgcgcugauguccugcccccugggggaggcccccagcccguacaacucgaaguucgaguccgucgccuggagcgccuccgcgugccacgacggcaugggcuggcucaccaucgggaucagcggccccgacaacggggccguggccgugcugaaguacaacggcaucaucaccggcacgaucaaguccuggaagaagcagauccugcggacccaggagucggagugcgucugcaugaacggguccugcuucaccaucaugaccgacggccccagcaacaaggccgccuccuacaagaucuucaagaucgagaaggggaaggugaccaagagcaucgagcucaacgcgcccaacuucuacuacgaggagugcuccugcuacccggacacgggcaucgugaugugcgucugccgcgacaacuggcacgggucgaaccggcccuggguguccuucaaccagaaccuggacuaccagaucggcuacaucugcagcggcguguucggggacaacccccgccccgaggacggcgagggguccugcaacccggucaccguggacggcgccaacggggugaagggcuucagcuacaaguacggcaacggggucuggaucggccggaccaaguccaaccgccugcggaagggguucgagaugaucugggaccccaacggcuggacgaacaccgacucggacuucuccgugaagcaggacguggucgccaucaccgacuggagcggguacagcggcuccuucgugcagcaccccgagcucaccggccuggacugcauccgccccugcuucuggguggagcugguccgggggcucccgcgcgagaacacgaccaucuggaccucgggcuccagcaucuccuucugcggggugaacagcgacaccgccaacugguccuggcccgacggcgccgagcugcccuucacgaucgacaaguga

SEQ ID NO: 23626 - RNA, 1413 nt, Artificial Sequence
  derived and/or modified CDS sequence (AUadapt) from InfluenzaA__AET84418__NA
augaaccccaaccagcgcaucaucgccaucggcucgaucuccaucgccaucgggaucaucagccugaugcuccagaucggcaacaucaucuccaucugggcgucgcacuccauccagaucgggagccagaacaacaccggcaucugcaaccagcggaucaucaccuacgagaacuccacgugggugaaccacaccuacgucaacaucaacaacaccaacgugguggccggggaggacaagaccagcgucacgcuggccggcaacuccucgcugugcuccaucagcggcugggccaucuacaccaaggacaacuccauccgcaucgggagcaagggcgacguguucgugauccgggagccguucaucuccugcucgcaccucgagugccgcaccuucuuccugacccagggggcccugcucaacgacaagcacuccaacggcacggcgaaggaccggagccccuaccgcgcccugauguccugcccccugggggaggcccccagcccguacaacucgaaguucgaguccgucgccuggagcgcguccgccugccacgacggcaugggcuggcucaccaucgggaucagcggccccgacaacggggccguggccgugcugaaguacaacggcaucaucaccgagaccaucaaguccuggaagaagcagauccugcggacgcaggagucggagugcgucugcaugaacggcuccugcuucaccaucaugaccgacgggcccagcaacaaggccgcguccuacaagaucuucaagaucgagaagggcaaggugaccaagagcaucgagcucaacgcccccaacuucuacuacgaggagugcuccugcuacccggacacggggaucgugaugugcgucugccgcgacaacuggcacggcucgaaccggcccuggguguccuucaaccagaaccuggacuaccagaucggguacaucugcagcggcguguucggcgacaacccccgccccgaggacggggagggcuccugcaacccggucaccguggacggggccaacggcgugaagggguucagcuacaaguacggcaacggcgucuggaucgggcggaccaaguccaaccgccugcggaagggcuucgagaugaucugggaccccaacggguggaccaacacggacucggacuucuccgugaagcaggacguggucgccaucaccgacuggagcggcuacagcggguccuucgugcagcaccccgagcucaccggccuggacugcauccgccccugcuucuggguggagcugguccggggccucccgcgcgagaacaccacgaucuggaccucgggguccagcaucuccuucugcggcgugaacagcgacaccgccaacugguccuggcccgacggggcggagcugcccuucaccaucgacaaguga

SEQ ID NO: 23627 - RNA, 1413 nt, Artificial Sequence
  derived and/or modified CDS sequence (AUadapt) from InfluenzaA__AET84429__NA
augaaccccaaccagaagaucaucaccaucggcucgaucuccaucgccaucgggaucaucagccugaugcuccagaucggcaacaucaucuccaucugggccagccacuccauccagaccgggucgcagaacaacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcucgaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcgcacccaggaguccgagugcgugugcaugaacgggucgugcuucaccaucaugacggacggccccuccaacaaggccgccagcuacaagaucuucaagaucgagaaggggaaggugaccaaguccaucgagcucaacgcccccaacuucuacuacgaggagugcagcugcuacccggacaccggcaucgucaugugcgugugccgggacaacuggcacggguccaaccgccccugggugucguucaaccaggaccuggacuaccagaucggcuacaucugcuccggcgucuucggggacaacccccggcccaaggacggcgaggggagcugcaacccggugaccguggacggcgcgaacggggucaagggcuucuccuacaaguacggcaacgggguguggaucggccgcaccaagagcaaccggcugcgcaagggguucgagaugaucugggaccccaacggcuggacgaacaccgacuccgacuucucggugaagcaggacgucguggccaucaccgacuggagcggguacuccggcagcuucgugcagcaccccgagcucacgggccuggacugcauccggcccugcuucugggucgagcuggugcgcgggcucccgcgggagaacaccaccaucuggaccuccggcucguccaucagcuucugcggggucaacuccgacacggccaacuggagcuggcccgacggcgccgagcugcccuucaccaucgacaaguga

SEQ ID NO: 23628 - RNA, 1413 nt, Artificial Sequence
  derived and/or modified CDS sequence (AUadapt) from InfluenzaA__AET84440__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagucggagugcgugugcaugaacggcuccugcuucaccaucaugacggacgggcccagcaacaaggccgccuccuacaagaucuucaagaucgagaagggcaaggugaccaagagcaucgagcucaacgcccccaacuucuacuacgaggagugcuccugcuacccggacaccgggaucgucaugugcgugugccgggacaacuggcacggcucgaaccgccccuggguguccuucaaccagaaccuggacuaccagaucggguacaucugcagcggcgucuucggcgacaacccccggcccaaggacggggagggcuccugcaacccggugaccguggacggggcgaacggcgucaagggguucagcuacaaguacggcaacggcguguggaucgggcgcacgaaguccaaccggcugcgcaagggcuucgagaugaucugggaccccaacggguggaccaacaccgacucggacuucuccgugaagcaggacgucguggccaucaccgacuggagcggcuacagcggguccuucgugcagcaccccgagcucacgggccuggacugcauccggcccugcuucugggucgagcuggugcgcggccucccgcgggagaacaccaccaucuggaccucgggguccagcaucuccuucugcggcgucaacagcgacacggccaacugguccuggcccgacggggccgagcugcccuucaccaucgacaaguga

SEQ ID NO: 23629 - RNA, 1413 nt, Artificial Sequence
  derived and/or modified CDS sequence (AUadapt) from InfluenzaA__AET84451__NA
augaaccccaaccagaagaucaucaccaucggcucgaucuccaucgccaucgggaucaucagccugauccuccagaucggcaacaucaucuccaucugggccucgcacuccauccagaccgggagccagaaccacacgggcaucugcaaccagcgcaucaucaccuacgagaacuccaccugggugaacaacaccuacgucaacaucaacaacacgaacgugguggcggagaaggacaagaccucggucacccuggccgggaacuccagccugugcuccaucucgggcugggccaucuacaccaaggacaacuccauccggaucggcagcaagggggacguguucgugauccgcgagccguucaucuccugcucgcaccucgagugccggacguucuuccugaccaagggcgcccugcucaacgacaagcacuccaacgggaccgucaccgaccgcagccccuaccgggcccugauguccugcccccugggcgaggcgcccucgccguacaacagccgcuucgaguccguggccuggagcgccuccgccugccacgacgggaugggcuggcucacgaucggcaucucggggcccgacaacggcgcgguggccguccugaaguacaacgggaucaucaccgagaccaucaaguccuggaagaagcggauccugcgcacccaggagagcgagugcgugugcaugaacggcuccugcuucacgaucaugaccgacggccccucgaacggggccgccuccuacaagaucuucaagaucgagaagggcaaggugaccaagaccaucgagcucaacgcccccaacuuccacuacgaggagugcagcugcuacccggacacggggaccgucaugugcgugugccgggacaacuggcacggcuccaaccgccccugggugucguucaaccagaaccuggacuaccagaucggguacaucugcuccggcgucuucggcgacaacccccggcccaaggacggggagggcagcugcaacccggugaccguggacggggcggacggcgucaagggguucuccuacaaguacggcaacggcguguggaucgggcgcaccaagucgaaccggcugcgcaagggcuucgagaugaucugggaccccaacggguggacgaacaccgacuccgacuucagcgugaagcaggacgucguggccaucaccgacugguccggcuacucggggagcuucgugcagcaccccgagcucaccggccuggacugcauccggcccugcuucugggucgagcuggugcgcggccucccgcgggagaacacgaccaucuggaccuccgggucguccaucagcuucugcggcgucaacuccgggaccgccaacuggagcuggcccgacggcgccgagcugcccuucacgaucgacaaguga

SEQ ID NO: 23630 - RNA, 1410 nt, Artificial Sequence; identical to SEQ ID NO: 16318
  derived and/or modified CDS sequence (AUadapt) from InfluenzaA__AEV53421__NA

SEQ ID NO: 23631 - RNA, 1410 nt, Artificial Sequence; identical to SEQ ID NO: 16318
  derived and/or modified CDS sequence (AUadapt) from InfluenzaA__AEV53423__NA

SEQ ID NO: 23632 - RNA, 1410 nt, Artificial Sequence; identical to SEQ ID NO: 20602
  derived and/or modified CDS sequence (AUadapt) from InfluenzaA__AEV53425__NA

SEQ ID NO: 23633 - RNA, 1410 nt, Artificial Sequence; identical to SEQ ID NO: 16318
  derived and/or modified CDS sequence (AUadapt) from InfluenzaA__AEV53427__NA

SEQ ID NO: 23634 - RNA, 1410 nt, Artificial Sequence; identical to SEQ ID NO: 20602
  derived and/or modified CDS sequence (AUadapt) from InfluenzaA__AEV53429__NA

SEQ ID NO: 23635 - RNA, 1410 nt, Artificial Sequence
  derived and/or modified CDS sequence (AUadapt) from InfluenzaA__AEV53431__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucgugccggugaagcuggccgggaacuccucgcucugccccgucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgccguaccgcacgcugauguccugccccaucggcgagguccccagccccuacaacucccgguucgagagcguggccuggagcgcguccgccugccacgacgggaucaacuggcucaccaucggcaucucgggcccggacaacggggccguggccguccugaaguacaacggcaucaucaccgacaccaucaaguccuggcgcaacaacauccugcggacgcaggagagcgagugcgcgugcgugaacggguccugcuucaccgugaugaccgacggccccagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgcccgugggucuccuucaaccagaaccucgaguaccagaucggguacaucugcagcggcaucuucggggacaacccccggcccaacgacaagaccggcuccugcggccccgugagcuccaacggggccaacggcgugaagggguucucguucaaguacggcaacggggucuggaucggccgcaccaaguccaucagcagccggaacggcuucgagaugaucugggacccgaacggguggaccggcaccgacaacaacuucuccaucaagcaggacaucguggggaucaacgaguggagcggcuacuccgggucguucgugcagcaccccgagcugacgggccuggacugcauccgccccugcuucugggucgagcucauccggggccgccccaaggagaacaccaucuggaccuccgggagcuccaucagcuucugcggcgugaacuccgggaccgucggcuggagcuggccggacggcgccgagcugcccuucacgaucgacaaguga

SEQ ID NO: 23636 - RNA, 1410 nt, Artificial Sequence; identical to SEQ ID NO: 16318
  derived and/or modified CDS sequence (AUadapt) from InfluenzaA__AEV53435__NA

SEQ ID NO: 23637 - RNA, 1410 nt, Artificial Sequence
  derived and/or modified CDS sequence (AUadapt) from InfluenzaA__AEV53437__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacacgcugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacucgggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 23638 - RNA, 1410 nt, Artificial Sequence; identical to SEQ ID NO: 16318
  derived and/or modified CDS sequence (AUadapt) from InfluenzaA__AEV53439__NA

SEQ ID NO: 23639 - RNA, 1410 nt, Artificial Sequence; identical to SEQ ID NO: 16318
  derived and/or modified CDS sequence (AUadapt) from InfluenzaA__AEV53441__NA

SEQ ID NO: 23640 - RNA, 1410 nt, Artificial Sequence; identical to SEQ ID NO: 16318
  derived and/or modified CDS sequence (AUadapt) from InfluenzaA__AEV53443__NA

SEQ ID NO: 23641 - RNA, 1410 nt, Artificial Sequence
  derived and/or modified CDS sequence (AUadapt) from InfluenzaA__AEV53445__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgaccacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 23642 - RNA, 1410 nt, Artificial Sequence; identical to SEQ ID NO: 16318
  derived and/or modified CDS sequence (AUadapt) from InfluenzaA__AEV53447__NA

SEQ ID NO: 23643 - RNA, 1410 nt, Artificial Sequence; identical to SEQ ID NO: 21042
  derived and/or modified CDS sequence (AUadapt) from InfluenzaA__AEV53449__NA

SEQ ID NO: 23644 - RNA, 1410 nt, Artificial Sequence
  derived and/or modified CDS sequence (AUadapt) from InfluenzaA__AEV53451__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuucaagaucgagaaggggaagaucgucaaguccguggagaugaacgcccccgacuaccacuacgaggagugcagcugcuaccccgacuccagcgagaucacgugcgugugccgcgacaacuggcacggcuccaaccggcccugggucucguucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 23645 - RNA, 1410 nt, Artificial Sequence; identical to SEQ ID NO: 16318
  derived and/or modified CDS sequence (AUadapt) from InfluenzaA__AEV53453__NA

SEQ ID NO: 23646 - RNA, 1410 nt, Artificial Sequence
  derived and/or modified CDS sequence (AUadapt) from InfluenzaA__AEV53455__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccgagaccgacaacaacuucucgaucaagcaggacaucgugggcaucaacgagugguccggguacagcggcuccuucgugcagcacccggagcugacggggcugaacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 23647 - RNA, 1410 nt, Artificial Sequence
  derived and/or modified CDS sequence (AUadapt) from InfluenzaA__AEV53457__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcgucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 23648 - RNA, 1410 nt, Artificial Sequence
  derived and/or modified CDS sequence (AUadapt) from InfluenzaA__AEV53459__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaucaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccgagaccgacaacaacuucucgaucaagcaggacaucgugggcaucaacgagugguccggguacagcggcuccuucgugcagcacccggagcugacggggcugaacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 23649 - RNA, 1410 nt, Artificial Sequence; identical to SEQ ID NO: 16318
  derived and/or modified CDS sequence (AUadapt) from InfluenzaA__AEV53461__NA

SEQ ID NO: 23650 - RNA, 1410 nt, Artificial Sequence
  derived and/or modified CDS sequence (AUadapt) from InfluenzaA__AEV53463__NA
augaaccccaaccagaagaucaucaccaucggcucggugugcaugaccaucgggauggccaaccugauccuccagaucggcaacaucaucuccaucuggaucagccacuccauccagcuggagaaccagaaccagaucgagacgugcaaccagagcgucaucaccuacgagaacaacaccugggugaaccagaccuacgugaacaucuccaacacgaacuucgccgcggggcagagcgucguguccgugaagcuggccggcaacucgucccucugcccggucagcgggugggccaucuacuccaaggacaacagcauccgcaucggcuccaagggcgacguguucgugauccgggagcccuucaucagcugcagcccccuggagugccgcaccuucuuccugacccagggggcccuccugaacgacaagcacuccaacggcaccaucaaggaccggucccccuaccgcacgcugaugucgugcccgaucggggagguccccucccccuacaacagccgguucgagagcguggccugguccgcgagcgccugccacgacggcaucaacuggcucaccaucgggaucuccggccccgacaacggcgccguggccguccugaaguacaacgggaucaucaccgacaccaucaagagcuggcgcaacaacauccugcggacgcaggaguccgagugcgcgugcaucaacggcucgugcuucaccgugaugaccgacgggccguccgacggccaggccagcuacaagaucuuccgcaucgagaagggcaagaucgugaaguccgucgagaugaacgcccccaacuaccacuacgaggagugcagcugcuaccccgacuccagcgagaucacgugcgugugccgggacaacuggcacggguccaaccgccccugggugucguucaaccagaaccucgaguaccagaucggcuacaucugcuccgggaucuucggcgacaacccgcggcccaacgacaagaccgggagcugcggccccgucuccagcaacggcgccaacggggugaagggcuucuccuucaaguacgggaacggcguguggaucgggcgcaccaagagcaucagcucccggaacggcuucgagaugaucugggaccccaacggcuggaccgggaccgacaacaacuucucgaucaagcaggacaucgucggcaucaacgagugguccggguacagcggcuccuucgugcagcacccggagcugacggggcuggacugcauccgccccugcuucuggguggagcucauccggggccgccccaaggagaacaccaucuggaccagcggcuccagcaucuccuucugcggggucaacagcgacaccgugggcugguccuggcccgacggggccgagcugccguucacgaucgacaaguga

SEQ ID NO: 23651 - RNA, 1410 nt, Artificial Sequence
  derived and/or modified CDS sequence (AUadapt) from InfluenzaA__AEV53465__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgaccgccaggccagcuacaagaucuuccggaucgagaagggcaagaucgucaaguccguggagaugaacgcccccaacuaccacuacgaggagugcucgugcuaccccgacuccagcgagaucacgugcgugugccgcgacaacuggcacggguccaaccggcccugggucagcuucaaccagaaccucgaguaccagaucggcuacaucugcuccgggaucuucggcgacaacccgcgccccaacgacaagaccgggagcugcggccccguguccucgaacggcgccaacggggugaagggcuucuccuacaaguacgggaacggcgucuggaucgggcggaccaagagcaucagcucccgcaacggcuucgagaugaucugggaccccaacggcuggaccgggaccgacaacaacuucagcaucaagcaggacaucgugggcaucaacgagugguccggguacucgggcuccuucgugcagcacccggagcugacggggcuggacugcauccggcccugcuucugggucgagcucauccgcggccggcccaaggagaacaccaucuggaccagcggcuccagcaucuccuucugcggggugaacagcgacaccgucggcugguccuggcccgacggggccgagcugccguucacgaucgacaaguga

SEQ ID NO: 23652 - RNA, 1410 nt, Artificial Sequence; identical to SEQ ID NO: 20941
  derived and/or modified CDS sequence (AUadapt) from InfluenzaA__AEV53467__NA

SEQ ID NO: 23653 - RNA, 1410 nt, Artificial Sequence; identical to SEQ ID NO: 20941
  derived and/or modified CDS sequence (AUadapt) from InfluenzaA__AEV53469__NA

SEQ ID NO: 23654 - RNA, 1410 nt, Artificial Sequence; identical to SEQ ID NO: 16318
  derived and/or modified CDS sequence (AUadapt) from InfluenzaA__AEV53471__NA

SEQ ID NO: 23655 - RNA, 1410 nt, Artificial Sequence; identical to SEQ ID NO: 16318
  derived and/or modified CDS sequence (AUadapt) from InfluenzaA__AEV53473__NA

SEQ ID NO: 23656 - RNA, 1410 nt, Artificial Sequence; identical to SEQ ID NO: 16318
  derived and/or modified CDS sequence (AUadapt) from InfluenzaA__AEV53475__NA

SEQ ID NO: 23657 - RNA, 1410 nt, Artificial Sequence; identical to SEQ ID NO: 16318
  derived and/or modified CDS sequence (AUadapt) from InfluenzaA__AEV53477__NA

SEQ ID NO: 23658 - RNA, 1410 nt, Artificial Sequence; identical to SEQ ID NO: 16318
  derived and/or modified CDS sequence (AUadapt) from InfluenzaA__AEV53479__NA

SEQ ID NO: 23659 - RNA, 1410 nt, Artificial Sequence; identical to SEQ ID NO: 16318
  derived and/or modified CDS sequence (AUadapt) from InfluenzaA__AEV53481__NA

SEQ ID NO: 23660 - RNA, 1410 nt, Artificial Sequence; identical to SEQ ID NO: 16318
  derived and/or modified CDS sequence (AUadapt) from InfluenzaA__AEV53483__NA

SEQ ID NO: 23661 - RNA, 1410 nt, Artificial Sequence
  derived and/or modified CDS sequence (AUadapt) from InfluenzaA__AEV53485__NA
augaaccccaaccagaagaucaucaccaucggcucggugugcaugaccaucgggauggccaaccugauccuccagaucggcaacaucaucuccaucugggucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacucgucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 23662 - RNA, 1410 nt, Artificial Sequence; identical to SEQ ID NO: 20941
  derived and/or modified CDS sequence (AUadapt) from InfluenzaA__AEV53487__NA

SEQ ID NO: 23663 - RNA, 1410 nt, Artificial Sequence; identical to SEQ ID NO: 20158
  derived and/or modified CDS sequence (AUadapt) from InfluenzaA__AEV53489__NA

SEQ ID NO: 23664 - RNA, 1410 nt, Artificial Sequence
  derived and/or modified CDS sequence (AUadapt) from InfluenzaA__AEV53491__NA
augaaccccaaccagaagaucaucaccaucggccuggugugcaugaccaucgggauggccaaccucauccugcagaucggcaacaucaucucgaucuggaucucccacagcauccagcuggggaaccagaaccagaucgagacgugcaaccaguccgucaucaccuacgagaacaacaccugggugaaccagaccuacgugaacaucagcaacacgaacuucgccgcgggccaguccgucgugagcgugaagcucgccgggaacuccucgcugugcccggucuccggcugggccaucuacagcaaggacaacuccauccgcaucggcagcaagggggacguguucgugauccgggagcccuucaucuccugcagcccccuggagugccgcaccuucuuccucacccagggcgcccugcugaacgacaagcacuccaacgggaccaucaaggaccggagccccuaccgcacgcucauguccugcccgaucggcgagguccccucgcccuacaacucccgguucgagagcguggccuggagcgcguccgccugccacgacgggaucaacuggcugaccaucggcaucagcggccccgacaacggggccguggccguccugaaguacaacggcaucaucaccgacaccaucaaguccuggcgcaacaacauccuccggacgcaggagagcgagugcgcgugcgugaacggguccugcuucaccgugaugaccgacggcccgucggacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccuggaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccucgacugcauccgccccugcuucugggucgagcugauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 23665 - RNA, 1410 nt, Artificial Sequence; identical to SEQ ID NO: 16318
  derived and/or modified CDS sequence (AUadapt) from InfluenzaA__AEV53493__NA

SEQ ID NO: 23666 - RNA, 1410 nt, Artificial Sequence; identical to SEQ ID NO: 20602
  derived and/or modified CDS sequence (AUadapt) from InfluenzaA__AEV53495__NA

SEQ ID NO: 23667 - RNA, 1410 nt, Artificial Sequence
  derived and/or modified CDS sequence (AUadapt) from InfluenzaA__AEV53497__NA
augaaccccaaccagaagaucaucaccaucggcucggugugcaugaccaucgggauggccaaccugauccuccagaucggcaacaucaucuccaucuggaucagccacuccauccagcuggagaaccagaaccagaucgagacgugcaaccagagcgucaucaccuacgagaacaacaccugggugaaccagaccuacgugaacaucuccaacacgaacuucgccgcggggcagagcgucguguccgugaaccuggccggcaacucgucccucugcccggucagcgggugggccaucuacuccaaggacaacagcauccgcaucggcuccaagggcgacguguucgugauccgggagcccuucaucagcugcagcccccuggagugccgcaccuucuuccugacccagggggcccuccugaacgacaagcacuccaacggcaccaucaaggaccggucccccuaccgcacgcugaugucgugcccgaucggggagguccccucccccuacaacagccgguucgagagcguggccugguccgcgagcgccugccacgacggcaucaacuggcucaccaucgggaucuccggccccgacaacggcgccguggccguccugaaguacaacgggaucaucaccgacaccaucaagagcuggcgcaacaacauccugcggacgcaggaguccgagugcgcgugcgugaacggcucgugcuucaccgugaugaccgacgggccguccgacggccaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucucguucaaccagaaccucgaguaccagaucggcuacaucugcuccgggaucuucggcgacaacccgcggcccaacgacaagaccgggagcugcggccccguguccagcaacggcgccaacggggugaagggcuucuccuucaaguacgggaacggcgucuggaucgggcgcaccaagagcaucagcucccggaacggcuucgagaugaucugggaccccaacggcuggaccgggaccgacaacaacuucucgaucaagcaggacaucgugggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 23668 - RNA, 1410 nt, Artificial Sequence; identical to SEQ ID NO: 20158
  derived and/or modified CDS sequence (AUadapt) from InfluenzaA__AEV53499__NA

SEQ ID NO: 23669 - RNA, 1410 nt, Artificial Sequence; identical to SEQ ID NO: 16318
  derived and/or modified CDS sequence (AUadapt) from InfluenzaA__AEV53501__NA

SEQ ID NO: 23670 - RNA, 1410 nt, Artificial Sequence; identical to SEQ ID NO: 16318
  derived and/or modified CDS sequence (AUadapt) from InfluenzaA__AEV53503__NA

SEQ ID NO: 23671 - RNA, 1410 nt, Artificial Sequence; identical to SEQ ID NO: 16318
  derived and/or modified CDS sequence (AUadapt) from InfluenzaA__AEV53505__NA

SEQ ID NO: 23672 - RNA, 1410 nt, Artificial Sequence; identical to SEQ ID NO: 16318
  derived and/or modified CDS sequence (AUadapt) from InfluenzaA__AEV53507__NA

SEQ ID NO: 23673 - RNA, 1410 nt, Artificial Sequence; identical to SEQ ID NO: 16318
  derived and/or modified CDS sequence (AUadapt) from InfluenzaA__AEV53509__NA

SEQ ID NO: 23674 - RNA, 1410 nt, Artificial Sequence; identical to SEQ ID NO: 20602
  derived and/or modified CDS sequence (AUadapt) from InfluenzaA__AEV53511__NA

SEQ ID NO: 23675 - RNA, 1410 nt, Artificial Sequence; identical to SEQ ID NO: 20602
  derived and/or modified CDS sequence (AUadapt) from InfluenzaA__AEV53513__NA

SEQ ID NO: 23676 - RNA, 1410 nt, Artificial Sequence; identical to SEQ ID NO: 20602
  derived and/or modified CDS sequence (AUadapt) from InfluenzaA__AEV53515__NA

SEQ ID NO: 23677 - RNA, 1410 nt, Artificial Sequence
  derived and/or modified CDS sequence (AUadapt) from InfluenzaA__AEV53517__NA
augaaccccaaccagcgcaucaucaccaucggcucggugugcaugaccaucgggauggccaaccugauccuccagaucggcaacaucaucuccaucugggucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacucgucccucugcccggugagcggcugggccaucuacuccaaggacaacagcauccggaucggcuccaagggggacguguucgucauccgcgagcccuucaucagcugcagcccccuggagugccggaccuucuuccugacccagggcgcccuccugaacgacaagcacuccaacgggaccaucaaggaccgcucccccuaccggacgcugaugucgugcccgaucggcgaggugcccucccccuacaacagccgcuucgagagcguggccugguccgcgagcgccugccacgacgggaucaacuggcucaccaucggcaucuccggccccgacaacggggccgucgccgugcugaaguacaacggcaucaucaccgacaccaucaagagcuggcggaacaacauccugcgcacgcaggaguccgagugcgcgugcgugaacgggucgugcuucaccgucaugaccgacggcccguccgacggccaggccagcuacaagaucuuccggaucgagaaggggaagaucgugaaguccguggagaugaacgcccccaacuaccacuacgaggagugcagcugcuaccccgacuccagcgagaucacgugcgucugccgcgacaacuggcacggcuccaaccggcccugggugucguucaaccagaaccucgaguaccagaucggguacaucugcuccggcaucuucggggacaacccgcgccccaacgacaagaccggcagcugcggccccguguccagcaacggggccaacggcgucaagggguucuccuucaaguacggcaacgggguguggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 23678 - RNA, 1410 nt, Artificial Sequence; identical to SEQ ID NO: 16318
  derived and/or modified CDS sequence (AUadapt) from InfluenzaA__AEV53519__NA

SEQ ID NO: 23679 - RNA, 1410 nt, Artificial Sequence; identical to SEQ ID NO: 20602
  derived and/or modified CDS sequence (AUadapt) from InfluenzaA__AEV53521__NA

SEQ ID NO: 23680 - RNA, 1410 nt, Artificial Sequence; identical to SEQ ID NO: 20428
  derived and/or modified CDS sequence (AUadapt) from InfluenzaA__AEV53523__NA

SEQ ID NO: 23681 - RNA, 1410 nt, Artificial Sequence; identical to SEQ ID NO: 19494
  derived and/or modified CDS sequence (AUadapt) from InfluenzaA__AEV53525__NA

SEQ ID NO: 23682 - RNA, 1410 nt, Artificial Sequence; identical to SEQ ID NO: 16318
  derived and/or modified CDS sequence (AUadapt) from InfluenzaA__AEV53527__NA

SEQ ID NO: 23683 - RNA, 1410 nt, Artificial Sequence
  derived and/or modified CDS sequence (AUadapt) from InfluenzaA__AEV53529__NA
augaaccccaaccagaagaucaucaccaucggcucggugugcaugaccaucgggauggccaaccugauccuccagaucggcaacaucaucuccaucuggaucagccacuccauccagcuggagaaccagaaccagaucgagacgugcaaccagagcgucaucaccuacgagaacaacaccugggugaaccagaccuacgugaacaucuccaacacgaacuucgccgcggggcagagcgucguguccgugaagcuggccggcaacucgucccucugcccggucagcgggugggccaucuacuccaaggacaacagcauccgcaucggcuccaagggcgacguguucgugauccgggagcccuucaucagcugcagcccccuggagugccgcaccuucuuccugacccagggggcccuccugaacgacaagcacuccaacggcaccaucaaggaccggucccccuaccgcacgcugaugucgugcccgaucggggagguccccucccccuacaacagccgguucgagagcguggccugguccgcgagcgccugccacgacggcaucaacuggcucaccaucgggaucuccggccccgacaacggcgccguggccguccugaaguacaacgggaucaucaccgacaccaucaagagcuggcgcaacaacauccugcggacgcaggaguccgagugcgcgugcgugaacggcucgugcuucaccgugaugaccgacgggccguccgacggccaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucucguucaaccagaaccucgaguaccagaucggcuacaucugcuccgggaucuucggcgacaacccgcggcccaacgacaagaccgggagcugcggccccguguccagcaacggcgccaacggggugaagggcuucuccuucaaguacgggaacggcgucuggaucgggcgcaccaagagcaucagcucccggaacggcuucgagaugaucugggaccccaacggcuggaccgggaccgacaacaacuucucgaucaagcaggacaucgugggcaucaaggagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 23684 - RNA, 1410 nt, Artificial Sequence; identical to SEQ ID NO: 20602
  derived and/or modified CDS sequence (AUadapt) from InfluenzaA__AEV53531__NA

SEQ ID NO: 23685 - RNA, 1410 nt, Artificial Sequence
  derived and/or modified CDS sequence (AUadapt) from InfluenzaA__AEV53533__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuacuacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugacgggccugaacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 23686 - RNA, 1410 nt, Artificial Sequence; identical to SEQ ID NO: 16318
  derived and/or modified CDS sequence (AUadapt) from InfluenzaA__AEV53535__NA

SEQ ID NO: 23687 - RNA, 1410 nt, Artificial Sequence; identical to SEQ ID NO: 23661
  derived and/or modified CDS sequence (AUadapt) from InfluenzaA__AEV53537__NA

SEQ ID NO: 23688 - RNA, 1410 nt, Artificial Sequence; identical to SEQ ID NO: 16318
  derived and/or modified CDS sequence (AUadapt) from InfluenzaA__AEV53539__NA

SEQ ID NO: 23689 - RNA, 1410 nt, Artificial Sequence; identical to SEQ ID NO: 22579
  derived and/or modified CDS sequence (AUadapt) from InfluenzaA__AEV53541__NA

SEQ ID NO: 23690 - RNA, 1410 nt, Artificial Sequence; identical to SEQ ID NO: 22579
  derived and/or modified CDS sequence (AUadapt) from InfluenzaA__AEV53543__NA

SEQ ID NO: 23691 - RNA, 1410 nt, Artificial Sequence; identical to SEQ ID NO: 20788
  derived and/or modified CDS sequence (AUadapt) from InfluenzaA__AEV53545__NA

SEQ ID NO: 23692 - RNA, 1410 nt, Artificial Sequence; identical to SEQ ID NO: 22579
  derived and/or modified CDS sequence (AUadapt) from InfluenzaA__AEV53547__NA

SEQ ID NO: 23693 - RNA, 1410 nt, Artificial Sequence; identical to SEQ ID NO: 22579
  derived and/or modified CDS sequence (AUadapt) from InfluenzaA__AEV53549__NA

SEQ ID NO: 23694 - RNA, 1410 nt, Artificial Sequence; identical to SEQ ID NO: 22579
  derived and/or modified CDS sequence (AUadapt) from InfluenzaA__AEV53551__NA

SEQ ID NO: 23695 - RNA, 1410 nt, Artificial Sequence; identical to SEQ ID NO: 22579
  derived and/or modified CDS sequence (AUadapt) from InfluenzaA__AEV53553__NA

SEQ ID NO: 23696 - RNA, 1410 nt, Artificial Sequence; identical to SEQ ID NO: 23661
  derived and/or modified CDS sequence (AUadapt) from InfluenzaA__AEV53555__NA

SEQ ID NO: 23697 - RNA, 1410 nt, Artificial Sequence; identical to SEQ ID NO: 20158
  derived and/or modified CDS sequence (AUadapt) from InfluenzaA__AEV53557__NA

SEQ ID NO: 23698 - RNA, 1410 nt, Artificial Sequence; identical to SEQ ID NO: 16318
  derived and/or modified CDS sequence (AUadapt) from InfluenzaA__AEV53559__NA

SEQ ID NO: 23699 - RNA, 1410 nt, Artificial Sequence; identical to SEQ ID NO: 16318
  derived and/or modified CDS sequence (AUadapt) from InfluenzaA__AEV53561__NA

SEQ ID NO: 23700 - RNA, 1410 nt, Artificial Sequence; identical to SEQ ID NO: 20732
  derived and/or modified CDS sequence (AUadapt) from InfluenzaA__AEV53563__NA

SEQ ID NO: 23701 - RNA, 1410 nt, Artificial Sequence
  derived and/or modified CDS sequence (AUadapt) from InfluenzaA__AEV53565__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagucggucguguccgugaagcuggccgggaacagcucccucugcccggucaacggcugggccaucuacagcaaggacaacuccauccgcaucggcagcaagggggacguguucgugauccgggagcccuucaucuccugcucgccccuggagugccgcaccuucuuccugacccagggcgcccuccugaacgacaagcacuccaacgggaccaucaaggaccggagccccuaccgcacgcugauguccugcccgaucggcgagguccccagccccuacaacucccgguucgagucgguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgucggacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcucgaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucucgagccggaacggcuucgagaugaucugggaccccaacggguggaccggcaccgacaacaacuucuccaucaagcaggacaucguggggaucaacgaguggagcggcuacuccgggucguucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccgcugacgaucgacaaguga

SEQ ID NO: 23702 - RNA, 1410 nt, Artificial Sequence
  derived and/or modified CDS sequence (AUadapt) from InfluenzaA__AEV53567__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggccuggaucggccgcaccaagagcaucagcucccggaacggcuucgagaugaucugggaccccaacggguggaccgagaccgacaacaacuucagcaucaagcaggacaucgucggcaucaacgagugguccggguacucgggcuccuucgugcagcacccggagcugacggggcugaacugcauccgccccugcuucuggguggagcucauccggggccgccccaaggagaacaccaucuggaccagcggcuccagcaucuccuucugcggggucaacagcgacaccgugggcugguccuggcccgacggggcggagcugccguucacgaucgacaaguga

SEQ ID NO: 23703 - RNA, 1410 nt, Artificial Sequence; identical to SEQ ID NO: 16318
  derived and/or modified CDS sequence (AUadapt) from InfluenzaA__AEV53569__NA

SEQ ID NO: 23704 - RNA, 1410 nt, Artificial Sequence; identical to SEQ ID NO: 22579
  derived and/or modified CDS sequence (AUadapt) from InfluenzaA__AEV53571__NA

SEQ ID NO: 23705 - RNA, 1410 nt, Artificial Sequence; identical to SEQ ID NO: 22579
  derived and/or modified CDS sequence (AUadapt) from InfluenzaA__AEV53573__NA

SEQ ID NO: 23706 - RNA, 1410 nt, Artificial Sequence; identical to SEQ ID NO: 20941
  derived and/or modified CDS sequence (AUadapt) from InfluenzaA__AEV53575__NA

SEQ ID NO: 23707 - RNA, 1410 nt, Artificial Sequence
  derived and/or modified CDS sequence (AUadapt) from InfluenzaA__AEV53577__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcagccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 23708 - RNA, 1410 nt, Artificial Sequence; identical to SEQ ID NO: 23646
  derived and/or modified CDS sequence (AUadapt) from InfluenzaA__AEV53579__NA

SEQ ID NO: 23709 - RNA, 1410 nt, Artificial Sequence; identical to SEQ ID NO: 20941
  derived and/or modified CDS sequence (AUadapt) from InfluenzaA__AEV53581__NA

SEQ ID NO: 23710 - RNA, 1410 nt, Artificial Sequence; identical to SEQ ID NO: 20602
  derived and/or modified CDS sequence (AUadapt) from InfluenzaA__AEV53583__NA

SEQ ID NO: 23711 - RNA, 1410 nt, Artificial Sequence; identical to SEQ ID NO: 20602
  derived and/or modified CDS sequence (AUadapt) from InfluenzaA__AEV53585__NA

SEQ ID NO: 23712 - RNA, 1410 nt, Artificial Sequence
  derived and/or modified CDS sequence (AUadapt) from InfluenzaA__AEV76877__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcacgaccaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggacgaucaaggaccggucgcccuaccgcacccugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacacgaucaaguccuggcgcaacaacauccugcggacccaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcacggacaacaacuucuccaucaagcaggacaucgucgggaucaacgaguggucgggcuacuccgggagcuucgugcagcacccggagcugaccggccuggacugcauccgccccugcuucuggguggagcucauccggggccgccccaaggagaacaccaucuggaccuccgggagcuccaucagcuucugcggcgucaacuccgacacggugggguggagcuggcccgacggcgccgagcugccguucaccaucgacaaguga

SEQ ID NO: 23713 - RNA, 1410 nt, Artificial Sequence; identical to SEQ ID NO: 16318
  derived and/or modified CDS sequence (AUadapt) from InfluenzaA__AEW10576__NA

SEQ ID NO: 23714 - RNA, 1410 nt, Artificial Sequence; identical to SEQ ID NO: 16318
  derived and/or modified CDS sequence (AUadapt) from InfluenzaA__AEW10586__NA

SEQ ID NO: 23715 - RNA, 1410 nt, Artificial Sequence; identical to SEQ ID NO: 16318
  derived and/or modified CDS sequence (AUadapt) from InfluenzaA__AEW10596__NA

SEQ ID NO: 23716 - RNA, 1410 nt, Artificial Sequence; identical to SEQ ID NO: 16318
  derived and/or modified CDS sequence (AUadapt) from InfluenzaA__AEW10606__NA

SEQ ID NO: 23717 - RNA, 1410 nt, Artificial Sequence; identical to SEQ ID NO: 20027
  derived and/or modified CDS sequence (AUadapt) from InfluenzaA__AEW10616__NA

SEQ ID NO: 23718 - RNA, 1410 nt, Artificial Sequence
  derived and/or modified CDS sequence (AUadapt) from InfluenzaA__AEW10626__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccauggccgugcugaaguacaacggcaucaucaccgacaccaucaagagcuggcgcaacaacauccugcggacgcaggaguccgagugcgcgugcgucaacgggucgugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 23719 - RNA, 1410 nt, Artificial Sequence; identical to SEQ ID NO: 16318
  derived and/or modified CDS sequence (AUadapt) from InfluenzaA__AEW10636__NA

SEQ ID NO: 23720 - RNA, 1410 nt, Artificial Sequence; identical to SEQ ID NO: 16274
  derived and/or modified CDS sequence (AUadapt) from InfluenzaA__AEW10646__NA

SEQ ID NO: 23721 - RNA, 1410 nt, Artificial Sequence; identical to SEQ ID NO: 16318
  derived and/or modified CDS sequence (AUadapt) from InfluenzaA__AEW10656__NA

SEQ ID NO: 23722 - RNA, 1410 nt, Artificial Sequence; identical to SEQ ID NO: 16318
  derived and/or modified CDS sequence (AUadapt) from InfluenzaA__AEW10666__NA

SEQ ID NO: 23723 - RNA, 1410 nt, Artificial Sequence; identical to SEQ ID NO: 16318
  derived and/or modified CDS sequence (AUadapt) from InfluenzaA__AEW10676__NA

SEQ ID NO: 23724 - RNA, 1410 nt, Artificial Sequence; identical to SEQ ID NO: 16318
  derived and/or modified CDS sequence (AUadapt) from InfluenzaA__AEW10686__NA

SEQ ID NO: 23725 - RNA, 1410 nt, Artificial Sequence; identical to SEQ ID NO: 16318
  derived and/or modified CDS sequence (AUadapt) from InfluenzaA__AEW10696__NA

SEQ ID NO: 23726 - RNA, 1410 nt, Artificial Sequence; identical to SEQ ID NO: 16318
  derived and/or modified CDS sequence (AUadapt) from InfluenzaA__AEW10706__NA

SEQ ID NO: 23727 - RNA, 1410 nt, Artificial Sequence; identical to SEQ ID NO: 16274
  derived and/or modified CDS sequence (AUadapt) from InfluenzaA__AEW10716__NA

SEQ ID NO: 23728 - RNA, 1410 nt, Artificial Sequence; identical to SEQ ID NO: 16318
  derived and/or modified CDS sequence (AUadapt) from InfluenzaA__AEW10726__NA

SEQ ID NO: 23729 - RNA, 1410 nt, Artificial Sequence; identical to SEQ ID NO: 16318
  derived and/or modified CDS sequence (AUadapt) from InfluenzaA__AEW10736__NA

SEQ ID NO: 23730 - RNA, 1410 nt, Artificial Sequence; identical to SEQ ID NO: 16274
  derived and/or modified CDS sequence (AUadapt) from InfluenzaA__AEW10746__NA

SEQ ID NO: 23731 - RNA, 1410 nt, Artificial Sequence; identical to SEQ ID NO: 16274
  derived and/or modified CDS sequence (AUadapt) from InfluenzaA__AEW10756__NA

SEQ ID NO: 23732 - RNA, 1410 nt, Artificial Sequence; identical to SEQ ID NO: 16274
  derived and/or modified CDS sequence (AUadapt) from InfluenzaA__AEW10766__NA

SEQ ID NO: 23733 - RNA, 1410 nt, Artificial Sequence; identical to SEQ ID NO: 16274
  derived and/or modified CDS sequence (AUadapt) from InfluenzaA__AEW10776__NA

SEQ ID NO: 23734 - RNA, 1410 nt, Artificial Sequence; identical to SEQ ID NO: 16274
  derived and/or modified CDS sequence (AUadapt) from InfluenzaA__AEW10786__NA

SEQ ID NO: 23735 - RNA, 1410 nt, Artificial Sequence; identical to SEQ ID NO: 16274
  derived and/or modified CDS sequence (AUadapt) from InfluenzaA__AEW10796__NA

SEQ ID NO: 23736 - RNA, 1410 nt, Artificial Sequence; identical to SEQ ID NO: 16274
  derived and/or modified CDS sequence (AUadapt) from InfluenzaA__AEW10806__NA

SEQ ID NO: 23737 - RNA, 1410 nt, Artificial Sequence; identical to SEQ ID NO: 16274
  derived and/or modified CDS sequence (AUadapt) from InfluenzaA__AEW10816__NA

SEQ ID NO: 23738 - RNA, 1410 nt, Artificial Sequence; identical to SEQ ID NO: 16318
  derived and/or modified CDS sequence (AUadapt) from InfluenzaA__AEW10826__NA

SEQ ID NO: 23739 - RNA, 1410 nt, Artificial Sequence; identical to SEQ ID NO: 16274
  derived and/or modified CDS sequence (AUadapt) from InfluenzaA__AEW10836__NA

SEQ ID NO: 23740 - RNA, 1410 nt, Artificial Sequence; identical to SEQ ID NO: 16274
  derived and/or modified CDS sequence (AUadapt) from InfluenzaA__AEW10846__NA

SEQ ID NO: 23741 - RNA, 1410 nt, Artificial Sequence; identical to SEQ ID NO: 16274
  derived and/or modified CDS sequence (AUadapt) from InfluenzaA__AEW10856__NA

SEQ ID NO: 23742 - RNA, 1410 nt, Artificial Sequence; identical to SEQ ID NO: 16274
  derived and/or modified CDS sequence (AUadapt) from InfluenzaA__AEW10866__NA

SEQ ID NO: 23743 - RNA, 1410 nt, Artificial Sequence; identical to SEQ ID NO: 16274
  derived and/or modified CDS sequence (AUadapt) from InfluenzaA__AEW10876__NA

SEQ ID NO: 23744 - RNA, 1410 nt, Artificial Sequence; identical to SEQ ID NO: 16274
  derived and/or modified CDS sequence (AUadapt) from InfluenzaA__AEW10886__NA

SEQ ID NO: 23745 - RNA, 1410 nt, Artificial Sequence; identical to SEQ ID NO: 16274
  derived and/or modified CDS sequence (AUadapt) from InfluenzaA__AEW10896__NA

SEQ ID NO: 23746 - RNA, 1410 nt, Artificial Sequence; identical to SEQ ID NO: 16274
  derived and/or modified CDS sequence (AUadapt) from InfluenzaA__AEW10906__NA

SEQ ID NO: 23747 - RNA, 1410 nt, Artificial Sequence; identical to SEQ ID NO: 16274
  derived and/or modified CDS sequence (AUadapt) from InfluenzaA__AEW10916__NA

SEQ ID NO: 23748 - RNA, 1410 nt, Artificial Sequence
  derived and/or modified CDS sequence (AUadapt) from InfluenzaA__AEW10926__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucaucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggucgugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 23749 - RNA, 1410 nt, Artificial Sequence; identical to SEQ ID NO: 16274
  derived and/or modified CDS sequence (AUadapt) from InfluenzaA__AEW10936__NA

SEQ ID NO: 23750 - RNA, 1410 nt, Artificial Sequence; identical to SEQ ID NO: 16274
  derived and/or modified CDS sequence (AUadapt) from InfluenzaA__AEW10946__NA

SEQ ID NO: 23751 - RNA, 1410 nt, Artificial Sequence; identical to SEQ ID NO: 16318
  derived and/or modified CDS sequence (AUadapt) from InfluenzaA__AEW10956__NA

SEQ ID NO: 23752 - RNA, 1410 nt, Artificial Sequence; identical to SEQ ID NO: 16318
  derived and/or modified CDS sequence (AUadapt) from InfluenzaA__AEW10966__NA

SEQ ID NO: 23753 - RNA, 1410 nt, Artificial Sequence; identical to SEQ ID NO: 16274
  derived and/or modified CDS sequence (AUadapt) from InfluenzaA__AEW10976__NA

SEQ ID NO: 23754 - RNA, 1410 nt, Artificial Sequence; identical to SEQ ID NO: 16318
  derived and/or modified CDS sequence (AUadapt) from InfluenzaA__AEW10986__NA

SEQ ID NO: 23755 - RNA, 1410 nt, Artificial Sequence; identical to SEQ ID NO: 16318
  derived and/or modified CDS sequence (AUadapt) from InfluenzaA__AEW10996__NA

SEQ ID NO: 23756 - RNA, 1410 nt, Artificial Sequence; identical to SEQ ID NO: 16318
  derived and/or modified CDS sequence (AUadapt) from InfluenzaA__AEW11006__NA

SEQ ID NO: 23757 - RNA, 1410 nt, Artificial Sequence; identical to SEQ ID NO: 16318
  derived and/or modified CDS sequence (AUadapt) from InfluenzaA__AEW11016__NA

SEQ ID NO: 23758 - RNA, 1410 nt, Artificial Sequence; identical to SEQ ID NO: 16318
  derived and/or modified CDS sequence (AUadapt) from InfluenzaA__AEW11026__NA

SEQ ID NO: 23759 - RNA, 1410 nt, Artificial Sequence; identical to SEQ ID NO: 16318
  derived and/or modified CDS sequence (AUadapt) from InfluenzaA__AEW11036__NA

SEQ ID NO: 23760 - RNA, 1410 nt, Artificial Sequence; identical to SEQ ID NO: 16274
  derived and/or modified CDS sequence (AUadapt) from InfluenzaA__AEW11046__NA

SEQ ID NO: 23761 - RNA, 1410 nt, Artificial Sequence; identical to SEQ ID NO: 16318
  derived and/or modified CDS sequence (AUadapt) from InfluenzaA__AEW11056__NA

SEQ ID NO: 23762 - RNA, 1410 nt, Artificial Sequence; identical to SEQ ID NO: 19944
  derived and/or modified CDS sequence (AUadapt) from InfluenzaA__AEW11066__NA

SEQ ID NO: 23763 - RNA, 1410 nt, Artificial Sequence; identical to SEQ ID NO: 19944
  derived and/or modified CDS sequence (AUadapt) from InfluenzaA__AEW11076__NA

SEQ ID NO: 23764 - RNA, 1410 nt, Artificial Sequence; identical to SEQ ID NO: 19944
  derived and/or modified CDS sequence (AUadapt) from InfluenzaA__AEW11086__NA

SEQ ID NO: 23765 - RNA, 1410 nt, Artificial Sequence; identical to SEQ ID NO: 19944
  derived and/or modified CDS sequence (AUadapt) from InfluenzaA__AEW11096__NA

SEQ ID NO: 23766 - RNA, 1410 nt, Artificial Sequence; identical to SEQ ID NO: 19944
  derived and/or modified CDS sequence (AUadapt) from InfluenzaA__AEW11106__NA

SEQ ID NO: 23767 - RNA, 1410 nt, Artificial Sequence; identical to SEQ ID NO: 16318
  derived and/or modified CDS sequence (AUadapt) from InfluenzaA__AEW11116__NA

SEQ ID NO: 23768 - RNA, 1410 nt, Artificial Sequence; identical to SEQ ID NO: 19944
  derived and/or modified CDS sequence (AUadapt) from InfluenzaA__AEW11126__NA

SEQ ID NO: 23769 - RNA, 1410 nt, Artificial Sequence; identical to SEQ ID NO: 19848
  derived and/or modified CDS sequence (AUadapt) from InfluenzaA__AEW11136__NA

SEQ ID NO: 23770 - RNA, 1410 nt, Artificial Sequence; identical to SEQ ID NO: 16318
  derived and/or modified CDS sequence (AUadapt) from InfluenzaA__AEW11146__NA

SEQ ID NO: 23771 - RNA, 1410 nt, Artificial Sequence; identical to SEQ ID NO: 16318
  derived and/or modified CDS sequence (AUadapt) from InfluenzaA__AEW11156__NA

SEQ ID NO: 23772 - RNA, 1410 nt, Artificial Sequence; identical to SEQ ID NO: 19944
  derived and/or modified CDS sequence (AUadapt) from InfluenzaA__AEW11166__NA

SEQ ID NO: 23773 - RNA, 1410 nt, Artificial Sequence; identical to SEQ ID NO: 19944
  derived and/or modified CDS sequence (AUadapt) from InfluenzaA__AEW11176__NA

SEQ ID NO: 23774 - RNA, 1410 nt, Artificial Sequence; identical to SEQ ID NO: 16318
  derived and/or modified CDS sequence (AUadapt) from InfluenzaA__AEW11186__NA

SEQ ID NO: 23775 - RNA, 1410 nt, Artificial Sequence; identical to SEQ ID NO: 19944
  derived and/or modified CDS sequence (AUadapt) from InfluenzaA__AEW11196__NA

SEQ ID NO: 23776 - RNA, 1410 nt, Artificial Sequence; identical to SEQ ID NO: 16318
  derived and/or modified CDS sequence (AUadapt) from InfluenzaA__AEW11206__NA

SEQ ID NO: 23777 - RNA, 1410 nt, Artificial Sequence; identical to SEQ ID NO: 16318
  derived and/or modified CDS sequence (AUadapt) from InfluenzaA__AEW11216__NA

SEQ ID NO: 23778 - RNA, 1410 nt, Artificial Sequence; identical to SEQ ID NO: 19848
  derived and/or modified CDS sequence (AUadapt) from InfluenzaA__AEW11226__NA

SEQ ID NO: 23779 - RNA, 1410 nt, Artificial Sequence; identical to SEQ ID NO: 16318
  derived and/or modified CDS sequence (AUadapt) from InfluenzaA__AEW11236__NA

SEQ ID NO: 23780 - RNA, 1410 nt, Artificial Sequence; identical to SEQ ID NO: 16318
  derived and/or modified CDS sequence (AUadapt) from InfluenzaA__AEW11246__NA

SEQ ID NO: 23781 - RNA, 1410 nt, Artificial Sequence; identical to SEQ ID NO: 19944
  derived and/or modified CDS sequence (AUadapt) from InfluenzaA__AEW11255__NA

SEQ ID NO: 23782 - RNA, 1410 nt, Artificial Sequence; identical to SEQ ID NO: 19944
  derived and/or modified CDS sequence (AUadapt) from InfluenzaA__AEW11265__NA

SEQ ID NO: 23783 - RNA, 1410 nt, Artificial Sequence; identical to SEQ ID NO: 16318
  derived and/or modified CDS sequence (AUadapt) from InfluenzaA__AEW11275__NA

SEQ ID NO: 23784 - RNA, 1410 nt, Artificial Sequence
  derived and/or modified CDS sequence (AUadapt) from InfluenzaA__AEW11285__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagaacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 23785 - RNA, 1410 nt, Artificial Sequence; identical to SEQ ID NO: 19944
  derived and/or modified CDS sequence (AUadapt) from InfluenzaA__AEW11295__NA

SEQ ID NO: 23786 - RNA, 1410 nt, Artificial Sequence; identical to SEQ ID NO: 16318
  derived and/or modified CDS sequence (AUadapt) from InfluenzaA__AEW11305__NA

SEQ ID NO: 23787 - RNA, 1410 nt, Artificial Sequence; identical to SEQ ID NO: 19944
  derived and/or modified CDS sequence (AUadapt) from InfluenzaA__AEW11315__NA

SEQ ID NO: 23788 - RNA, 1410 nt, Artificial Sequence; identical to SEQ ID NO: 16318
  derived and/or modified CDS sequence (AUadapt) from InfluenzaA__AEW11325__NA

SEQ ID NO: 23789 - RNA, 1410 nt, Artificial Sequence; identical to SEQ ID NO: 16318
  derived and/or modified CDS sequence (AUadapt) from InfluenzaA__AEW25299__NA

SEQ ID NO: 23790 - RNA, 1410 nt, Artificial Sequence; identical to SEQ ID NO: 16318
  derived and/or modified CDS sequence (AUadapt) from InfluenzaA__AEW25308__NA

SEQ ID NO: 23791 - RNA, 1410 nt, Artificial Sequence; identical to SEQ ID NO: 20213
  derived and/or modified CDS sequence (AUadapt) from InfluenzaA__AEW25317__NA

SEQ ID NO: 23792 - RNA, 1410 nt, Artificial Sequence; identical to SEQ ID NO: 16318
  derived and/or modified CDS sequence (AUadapt) from InfluenzaA__AEW25324__NA

SEQ ID NO: 23793 - RNA, 1410 nt, Artificial Sequence
  derived and/or modified CDS sequence (AUadapt) from InfluenzaA__AEW25327__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgaggucccgccgcccuacaacucccgguucgagagcguggccuggagcgcguccgccugccacgacgggaucaacuggcucaccaucggcaucucgggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggccccagcgacggccaggccuccuacaagaucuuccgcaucgagaaggggaagaucgucaagagcguggagaugaacgcccccaacuaccacugcgaggagugcuccugcuaccccgacucguccgagaucacgugcgugugccgggacaacuggcacggcagcaaccgccccugggucuccuucaaccagaaccucgaguaccagaucggguacaucugcagcggcaucuucggggacaacccccggcccaacgacaagaccggcuccugcggccccgugagcuccaacggggccaacggcgugaagggguucucguucaaguacggcaacggggucuggaucggccgcaccaaguccaucagcagccggaacggcuucgagaugaucugggacccgaacggguggaccggcaccgacaacaacuucuccaucaagcaggacaucguggggaucaacgaguggagcggcuacuccgggucguucgugcagcaccccgagcugacgggccuggacugcauccgccccugcuucugggucgagcucauccggggccgccccaaggagaacaccaucuggaccuccgggagcuccaucagcuucugcggcgugaacuccgacaccgucggguggagcuggccggacggcgccgagcugcccuucacgaucgacaaguga

SEQ ID NO: 23794 - RNA, 1410 nt, Artificial Sequence
  derived and/or modified CDS sequence (AUadapt) from InfluenzaA__AEW25333__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccacaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucugggugggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccacugcuucuggguggagcucauccggggccgccccaaggagaacaccaucuggaccagcggguccagcaucuccuucugcggcgucaacagcgacaccguggggugguccuggcccgacggcgccgagcugcccuucacgaucgacaaguga

SEQ ID NO: 23795 - RNA, 1410 nt, Artificial Sequence
  derived and/or modified CDS sequence (AUadapt) from InfluenzaA__AEW25338__NA
augaaccccaaccagaagaucaucaccaucggcucggugugcauggccaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgcggccggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggcgugguccgccucggccugccacgacgggaucaacuggcucacgaucggcaucuccggccccgacaacggggccguggcgguccugaaguacaacggcaucaucaccgacaccaucaagagcuggcgcaacaacauccugcggacccaggaguccgagugcgccugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacauccgguccggcaucuucggggacaacccgcgccccaacgacaagaccggcagcugcggccccguguccucgaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacucgggguccuucgugcagcacccggagcugaccggccuggacugcauccggcccugcuucugggucgagcucauccgcggccggcccaaggagaacacgaucuggaccagcggguccagcaucuccuucugcggcgugaacagcgacaccgucgggugguccuggcccgacggcgcggagcugccguucaccaucgacaaguga

SEQ ID NO: 23796 - RNA, 1410 nt, Artificial Sequence
  derived and/or modified CDS sequence (AUadapt) from InfluenzaA__AEW25343__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacucgaacgggaccaucaaggaccggucccccuaccgcacgcugaugagcugcccgaucggcgagguccccucccccuacaacagccggagcgaguccguggccuggagcgcguccgccugccacgacgggaucaacuggcucaccaucggcaucucgggccccgacaacggggccguggccguccugaaguacaacggcaucaucaccgacaccaucaaguccuggcgcaacaacauccugcggacgcaggagagcgugugcgcgugcgugaacggguccugcuucaccgucaugaccgacggcccgagcgacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgccccuggguguccuucaaccagaaccucgaguaccagaucggguacaucugcucgggcaucuucggggacuccccgcggcccaacgacaagaccggcagcugcggccccguguccagcaacggggccaacggcgucaagggguucagcuucaaguacggcaacgggguguggaucggccgcaccaaguccaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 23797 - RNA, 1410 nt, Artificial Sequence
  derived and/or modified CDS sequence (AUadapt) from InfluenzaA__AEW25351__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccacaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaacgaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaccuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacucgggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 23798 - RNA, 1410 nt, Artificial Sequence
  derived and/or modified CDS sequence (AUadapt) from InfluenzaA__AEW25358__NA
augaaccccaaccagaagaucaucaccaucggcucggugugcaugaccaucgggauggccaaccugauccuccagaucggcaacaucaucuccaucugggucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacucgucccucugcccggugagcggcugggccaucuacuccaaggacaacagcauccgcaucggcuccaagggggacguguucgucauccgggagcccuucaccagcugcagcccccuggagugccgcaccuucuuccugacccagggcgcccuccugaacgacaagcacuccaacgggacgaucaaggaccggucccccuaccgcacccugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacacgaucaagagcuggcgcaacaacauccugcggacccaggaguccgagugcgcgugcgugaacgggucgugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcacggacaacaacuucucgaucaagcaggacaucguggggaucaacgagugguccggcuacagcggguccuucguccagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgccgagcugccguucaccaucgugaaguga

SEQ ID NO: 23799 - RNA, 1410 nt, Artificial Sequence; identical to SEQ ID NO: 16318
  derived and/or modified CDS sequence (AUadapt) from InfluenzaA__AEW25361__NA

SEQ ID NO: 23800 - RNA, 1410 nt, Artificial Sequence
  derived and/or modified CDS sequence (AUadapt) from InfluenzaA__AEW25379__NA
augaaccccaaccagaagaucaucaccaucggcucggugugcaugaccaucgggauggccaaccugauccuccagaucggcaacaucaucuccaucuggacgagccacuccauccagcuggggaaccagaaccagaucgagaccugcaaccagagcgucaucaccuacgagaacaacaccugggugaaccagacguacgugaacaucuccaacaccaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgaggugacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccucggacggggccaacggcgucaagggguucuccuucaaguacggcaacgggguguggaucggccgcaccaagagcaucagcucccggaacggcuucgagaugaucugggaccccaacggguggaccggcacggacaacaacuucagcaucaagcaggacaucguggggaucaacgagugguccggcuacucgggguccuucguccagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgccgagcugccguucaccaucgacaaguga

SEQ ID NO: 23801 - RNA, 1410 nt, Artificial Sequence
  derived and/or modified CDS sequence (AUadapt) from InfluenzaA__AEW25387__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcguggacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucgaggacaacccgcggcccaacgacaagaccgggagcugcggccccguguccagcaacggcgccaacggggugaagggcuucuccuucaaguacgggaacggcgucuggaucgggcgcaccaagagcaucagcucccggaacggcuucgagaugaucugggaccccaacggcuggaccgggaccgacaacaacuucucgaucaagcaggacaucgugggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 23802 - RNA, 1410 nt, Artificial Sequence
  derived and/or modified CDS sequence (AUadapt) from InfluenzaA__AEW25392__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcacgacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 23803 - RNA, 1410 nt, Artificial Sequence
  derived and/or modified CDS sequence (AUadapt) from InfluenzaA__AEW25397__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagcccguggccuggagcgcguccgccugccacgacgggaucaacuggcucaccaucggcaucagcggcccggacaacggggccguggccguccugaaguacaacggcaucaucaccgacaccaucaaguccuggcgcaacaacauccugcggacgcaggagagcgagugcgcgugcgugaacggguccugcuucaccgugaugaccgacggccccucggacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgcccgugggucuccuucaaccagaaccucgaguaccagaucggguacaucugcucgggcaucuucggggacagcccccggcccaacgacaagaccggcuccugcggccccguguccagcaacggggccaacggcgugaagggguucuccuucaaguacggcaacggggucuggaucggccgcaccaagagcaucagcucccggaacggcuucgagaugaucugggacccgaacggguggaccggcaccgacaacaacuucucgaucaagcaggacaucguggggaucaacgagugguccggcuacagcggguccuucgugcagcaccccgagcugacgggccuggacugcauccgccccugcuucugggucgagcucauccggggccgccccaaggagaacaccaucuggaccagcggguccagcaucuccuucugcggcgugaacagcgacaacgucgggugguccuggccggacggcgccgagcugcccuucaccaucgacaaguga

SEQ ID NO: 23804 - RNA, 1410 nt, Artificial Sequence; identical to SEQ ID NO: 16318
  derived and/or modified CDS sequence (AUadapt) from InfluenzaA__AEW25402__NA

SEQ ID NO: 23805 - RNA, 1410 nt, Artificial Sequence; identical to SEQ ID NO: 16318
  derived and/or modified CDS sequence (AUadapt) from InfluenzaA__AEW25407__NA

SEQ ID NO: 23806 - RNA, 1410 nt, Artificial Sequence
  derived and/or modified CDS sequence (AUadapt) from InfluenzaA__AEW25418__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccacaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgggaagggcaagaucgucaaguccguggagaugaacgcccccaacuaccacuacgaggagugcucgugcuaccccgacuccagcgagaucacgugcgugugccgggacaacuggcacggguccaaccgccccugggucagcuucaaccagaaccucgaguaccagaucggcuacaucugcuccgggaucuucggcgacaacccgcggcccaacgacaagaccggcagcugcgggcccguguccagcaacggcgagaacggggugaagggcuucuccuucaaguacgggaacggcgucuggaucggccgcaccaagagcaucucgucccggaacggguucgagaugaucugggaccccaacggcuggaccgggaccgacaacaacuucagcaucaagcaggacaucgugggcaucaacgagugguccggguacagcggcuccuucgugcagcacccggagcugacgggccuggacugcauccgccccugcuucugggucgagcucauccgggggcgccccaaggagaacaccaucuggaccagcggcuccagcaucuccuucugcggggugaacagcgacaccgucggcugguucuggcccgacggcgccgagcugccguucacgaucgacaaguga

SEQ ID NO: 23807 - RNA, 1410 nt, Artificial Sequence
  derived and/or modified CDS sequence (AUadapt) from InfluenzaA__AEW25423__NA
augaaccccaaccagaagaucaucaccaucggcucggugugcaugaccaucgggauggccaaccugauccuccagaucggcaacaucaucuccaucuggaucagcaacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 23808 - RNA, 1410 nt, Artificial Sequence; identical to SEQ ID NO: 16318
  derived and/or modified CDS sequence (AUadapt) from InfluenzaA__AEW25426__NA

SEQ ID NO: 23809 - RNA, 1410 nt, Artificial Sequence
  derived and/or modified CDS sequence (AUadapt) from InfluenzaA__AEW25432__NA
augaaccccaaccagaagaucaucaccaucggcucggugugcaugaccaucgggauggccaaccugauccuccagaucggcaacaucaucuccaucuggacgagccacuccauccagcuggggaaccagaaccagaucgagaccugcaaccagagcgucaucaccuacgagaacaacaccugggugaaccagacguacgugaacaucuccaacaccaacuucgccgcgggccagucggucguguccgugaagcuggccgggaacagcucccucugcccggucagcggcugggccaucuacuccaaggacaacucgauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugucgugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcucgugcggccccguguccagcaacggggccaacggcgugaagggguucuccuucaaguacggcaacggggucuggaucggccgcaccaagagcaucucgucccggaacggcuucgagaugaucugggaccccaacggguggaccggcacggacaacaacagcuccaucaagcaggacaucguggggaucaacgaguggagcggcuacuccgggucguucgugcagcacccggagcugaccggccuggacugcauccgccccugcuucugggucgagcucauccggggccgccccaaggagaacaccaucuggaccuccgggagcuccaucagcuucugcggcaucaacuccgacgccgugggguggagcuggcccgacggcgcggagcugccguucacgaucgacaaguga

SEQ ID NO: 23810 - RNA, 1410 nt, Artificial Sequence
  derived and/or modified CDS sequence (AUadapt) from InfluenzaA__AEW25436__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcaucaucaccuacgagaacaacaccugggucaaccagaccuacgugaacaucuccaacacgaacuucgccgcgggccagagcguggucuccgugaagcuggccgggaacucgucccucugcccggugagcggcugggccaucuacuccaaggacaacagcauccgcaucggcuccaagggggacgucuucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgucggccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccggaucggguacaucugcuccggcaucuucggggacaacccgcgccccaacgacaagaccggcagcugcggccccgucuccucgaacggggccaacggcgugaagggguucuccuucaaguacggcaacgggguguggaucggccggaccaagagcaucagcucccgcaacggcuucgagaugaucugggaccccaacggguggaccggcaccgacaacaacuucagcaucaagcaggacaucgucgggacgaacgagugguccggcuacucgggguccuucgugcagcacccggagcugaccggccuggacugcauccggcccugcuucuggguggagcucauccgcggccggcccaaggagaacaccaucuggaccagcggguccagcaucuccuucugcggcgucaacagcgacacgauggggugguccuggcccgacggcgccgagcugccguucaccaucgacaaguga

SEQ ID NO: 23811 - RNA, 1410 nt, Artificial Sequence; identical to SEQ ID NO: 16318
  derived and/or modified CDS sequence (AUadapt) from InfluenzaA__AEW25440__NA

SEQ ID NO: 23812 - RNA, 1410 nt, Artificial Sequence
  derived and/or modified CDS sequence (AUadapt) from InfluenzaA__AEW25448__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaccgacaaguga

SEQ ID NO: 23813 - RNA, 1410 nt, Artificial Sequence; identical to SEQ ID NO: 16318
  derived and/or modified CDS sequence (AUadapt) from InfluenzaA__AEW25456__NA

SEQ ID NO: 23814 - RNA, 1410 nt, Artificial Sequence
  derived and/or modified CDS sequence (AUadapt) from InfluenzaA__AEW25464__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagcucaacgcccccaacuaccacuacgaggagugcagcugcuaccccgacuccagcgagaucacgugcgugugccgggacaacuggcacggcuccaaccgccccugggucucguucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 23815 - RNA, 1410 nt, Artificial Sequence
  derived and/or modified CDS sequence (AUadapt) from InfluenzaA__AEW25474__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagucggucguguccgugaagcuggccgggaacagcucccucugcccggucagcggcugggccaucuacuccaaggacaacagcauccgcaucggcuccaagggggacguguucgugauccgggagcccuucaucucgugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacucgcgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagucgaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccucgggguccagcaucuccuucugcggcgugaacagcgacaccgucgggugguccuggcccgacggcgccgagcugccgagcacgaucgacaaguga

SEQ ID NO: 23816 - RNA, 1410 nt, Artificial Sequence
  derived and/or modified CDS sequence (AUadapt) from InfluenzaA__AEW25484__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccuggaucaaccagaccuacgugaacaucuccaacacgaacuucgccgcgggccagagcguggucuccgugaagcuggccgggaacucgucccucugcccggugagcggcugggccaucuacuccaaggacaacagcauccgcaucggcuccaagggggacgucuucgugauccgggagcccuucaucagcugcucccaccuggagugccgcaccuucuuccugacccagggcgcccuccugaacgacaagcacagcaacgggaccaucaaggaccggucccccuaccgcacgcugaugucgugccccaucggcgaggugccgucccccuacaacagccgguucgagagcgucgccugguccgcgagcgccugccacgacgggaucaacuggcucaccaucggcaucuccggccccgaccacggggccguggccgugcugaaguacaacggcaucaucaccgacaccaucaagagcuggcgcaacaacauccugcggacgcaggaguccgagugcgcgugcgucaacgggucgugcuucaccgugaugaccgacggccccuccgacggccaggccagcuacaagaucuuccgcaucgagaaggggaagaucgugaaguccgucgagaugaacgccccgaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccccggccgaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcaccccgagcugacgggccuggacugcauccgcccgugcuucuggguggagcucauccggggccgccccaaggagaacaccaucuggaccagcggguccagcaucuccuucugcggcgucaacagcgacaccguggggugguccuggcccgacggcgccgagcugcccuucacgaucgacaaguga

SEQ ID NO: 23817 - RNA, 1410 nt, Artificial Sequence
  derived and/or modified CDS sequence (AUadapt) from InfluenzaA__AEW25494__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacagcaucaaguccuggcgcaacaacauccugcggacccaggagagcgagugcgcgugcgugaacggguccugcuucacggugaugaccgacggcccgagcgacggccaggccuccuacaagaucuuccgcaucgagaaggggaagaucgucaagucgguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaccuucggggacaacccgcggcccaacgacaagaccggcuccugcggccccgugucguccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 23818 - RNA, 1410 nt, Artificial Sequence
  derived and/or modified CDS sequence (AUadapt) from InfluenzaA__AEW25503__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggccuggaucggccgcaccaagagcaucagcucccggaacggcuucgagaugaucugggaccccaacggguggaccggcaccgacaacaacuucagcaucaagcaggacaucgucgggaucaacgagugguccggcuacucgggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgcggagcugccguucacgaucgacaaguga

SEQ ID NO: 23819 - RNA, 1410 nt, Artificial Sequence
  derived and/or modified CDS sequence (AUadapt) from InfluenzaA__AEW25511__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccacaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggugguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagucgguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 23820 - RNA, 1410 nt, Artificial Sequence
  derived and/or modified CDS sequence (AUadapt) from InfluenzaA__AEW25530__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccacaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcuacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggagaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 23821 - RNA, 1410 nt, Artificial Sequence
  derived and/or modified CDS sequence (AUadapt) from InfluenzaA__AEW25537__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaaccaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 23822 - RNA, 1410 nt, Artificial Sequence; identical to SEQ ID NO: 16318
  derived and/or modified CDS sequence (AUadapt) from InfluenzaA__AEW25547__NA

SEQ ID NO: 23823 - RNA, 1410 nt, Artificial Sequence; identical to SEQ ID NO: 16318
  derived and/or modified CDS sequence (AUadapt) from InfluenzaA__AEW25556__NA

SEQ ID NO: 23824 - RNA, 1410 nt, Artificial Sequence; identical to SEQ ID NO: 16318
  derived and/or modified CDS sequence (AUadapt) from InfluenzaA__AEW25566__NA

SEQ ID NO: 23825 - RNA, 1410 nt, Artificial Sequence
  derived and/or modified CDS sequence (AUadapt) from InfluenzaA__AEW25584__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggggaucgugggcaucaacgagugguccggguacggcggcucguucgugcagcacccggagcugacggggcuggacugcauccgccccugcuucugggucgagcucauccggggccgccccaaggagaacaccaucuggaccuccgggagcuccaucagcuucugcggcgugaacuccgacaccgucggcuggagcuggcccgacggggccgagcugccguucacgaucgacaaguga

SEQ ID NO: 23826 - RNA, 1410 nt, Artificial Sequence; identical to SEQ ID NO: 16318
  derived and/or modified CDS sequence (AUadapt) from InfluenzaA__AEW25592__NA

SEQ ID NO: 23827 - RNA, 1410 nt, Artificial Sequence
  derived and/or modified CDS sequence (AUadapt) from InfluenzaA__AEW25602__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaagaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 23828 - RNA, 1410 nt, Artificial Sequence
  derived and/or modified CDS sequence (AUadapt) from InfluenzaA__AEW25612__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgaccgccaggccagcuacaagaucuuccggaucgagaagggcaagaucgucaaguccguggagaugaacgcccccaacuaccacuacgaggagugcagcugcuaccccgacuccagcgagaucacgugcgugugccgcgacaacuggcacggguccaaccggcccugggucucguucaaccagaaccucgaguaccagaucggcuacaucugcuccgggaucuucggcgacaacccgcgccccaacgacaagaccgggagcugcggccccguguccagcaacggcgccaacggggugaagggcuucuccuucaaguacgggaacggcgucuggaucgggcggaccaagagcaucagcucccgcaacggcuucgagaugaucugggaccccaacggcuggaccgggaccgacaacaacuucucgaucaagcaggacaucgugggcaucaacgagugguccggguacagcggcuccuucgugcagcacccggagcugacggggcuggacugcauccggcccugcuucugggucgagcucauccgcggccggcccaaggagaacaccaucuggaccagcggcuccagcaucuccuucugcggggugaacagcgacaccgucggcugguccuggcccgacggggccgagcugccguucacgaucgacaaguga

SEQ ID NO: 23829 - RNA, 1410 nt, Artificial Sequence
  derived and/or modified CDS sequence (AUadapt) from InfluenzaA__AEW25622__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcucgugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucgugcagcacccggagcugacgggccuggacugcauccgccccugcuucugggucgagcucauccggggccgccccaaggagaacagcaucuggaccuccgggagcuccaucagcuucugcggcgugaacuccgacaccgucggguggagcuggcccgacggcgccgagcugccguucaccaucgacaaguga

SEQ ID NO: 23830 - RNA, 1410 nt, Artificial Sequence
  derived and/or modified CDS sequence (AUadapt) from InfluenzaA__AEW25631__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcucgugcggccccguguccagcaacggggccuccggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 23831 - RNA, 1410 nt, Artificial Sequence; identical to SEQ ID NO: 16318
  derived and/or modified CDS sequence (AUadapt) from InfluenzaA__AEW25639__NA

SEQ ID NO: 23832 - RNA, 1410 nt, Artificial Sequence
  derived and/or modified CDS sequence (AUadapt) from InfluenzaA__AEW25648__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccacaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 23833 - RNA, 1410 nt, Artificial Sequence
  derived and/or modified CDS sequence (AUadapt) from InfluenzaA__AEW25656__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucccgaucaagcaggacaucguggggaucaacgaguggagcggcuacuccgggucguucgugcagcaccccgagcugacgggccuggacugcauccgccccugcuucugggucgagcucauccggggccgccccaaggagaacaccaucuggaccuccgggagcuccaucagcuucugcggcgugaacuccgacaccgucggguggagcuggccggacggcgccgagcugcccuucacgaucgacaaguga

SEQ ID NO: 23834 - RNA, 1410 nt, Artificial Sequence
  derived and/or modified CDS sequence (AUadapt) from InfluenzaA__AEW25664__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucaccgccggccagagcgucguguccgugaagcuggcggggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgccucggcgugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgccugcgugaacgggagcugcuucaccgugaugaccgacggcccguccgacggccaggcgagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacucgggguccuucgugcagcacccggagcugaccggccuggacugcauccgccccugcuucugggucgagcucauccggggccgccccaaggagaacaccaucuggaccagcggguccagcaucuccuucugcggcgugaacagcgacaccgggggcugguccuggcccgacggcgccgagcugccguucacgaucgacaaguga

SEQ ID NO: 23835 - RNA, 1410 nt, Artificial Sequence; identical to SEQ ID NO: 23829
  derived and/or modified CDS sequence (AUadapt) from InfluenzaA__AEW25671__NA

SEQ ID NO: 23836 - RNA, 1410 nt, Artificial Sequence; identical to SEQ ID NO: 20317
  derived and/or modified CDS sequence (AUadapt) from InfluenzaA__AEW25680__NA

SEQ ID NO: 23837 - RNA, 1410 nt, Artificial Sequence
  derived and/or modified CDS sequence (AUadapt) from InfluenzaA__AEW25689__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcgugggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 23838 - RNA, 1410 nt, Artificial Sequence; identical to SEQ ID NO: 23832
  derived and/or modified CDS sequence (AUadapt) from InfluenzaA__AEW25698__NA

SEQ ID NO: 23839 - RNA, 1410 nt, Artificial Sequence; identical to SEQ ID NO: 16318
  derived and/or modified CDS sequence (AUadapt) from InfluenzaA__AEW25708__NA

SEQ ID NO: 23840 - RNA, 1410 nt, Artificial Sequence; identical to SEQ ID NO: 16318
  derived and/or modified CDS sequence (AUadapt) from InfluenzaA__AEX09177__NA

SEQ ID NO: 23841 - RNA, 1413 nt, Artificial Sequence
  derived and/or modified CDS sequence (AUadapt) from InfluenzaA__AEX33324__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucacgaucaacaacaccaacgugguggcggggaaggacaagaccucggucacccuggccggcaacuccagccugugcuccaucagcggcugggccaucuacacgaaggacaacuccauccggaucgggucgaagggcgacguguucgugauccgcgagccguucaucuccugcagccaccucgagugccggaccuucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucacgaucgggaucagcggccccgacaacggggcgguggccguccugaaguacaacggcaucaucaccgagaccaucaaguccuggaagaagcgcauccugcggacccaggagucggagugcgugugcgugaacggcuccugcuucacgaucaugaccgacgggcccagcaacggcgccgccuccuacaagaucuucaagaucgagaaggggaaggucaccaagucgaucgagcucaacgcccccaacuuccacuacgaggagugcuccugcuacccggacaccggcacggugaugugcgugugccgcgacaacuggcacgggagcaaccggcccugggucuccuucaaccagaaccuggacuaccagaucggcuacaucugcucgggcguguucggggacaacccccgccccaaggacggcgagggguccugcaacccggugaccgucgacggcgcggacggggugaagggcuucagcuacaaguacggcaacgggguguggaucggccggaccaaguccaaccgccugcggaagggguucgagaugaucugggaccccaacggcuggaccgacacggacagcgacuucuccgucaagcaggacgugguggccaucaccgacuggucgggguacagcggcuccuucguccagcaccccgagcucaccggccuggacugcauccgccccugcuucuggguggagcugguccgggggcucccgcgcgagaacaccacgaucuggaccucgggcuccagcaucuccuucugcggggugaacagcgacaccgccaacugguccuggcccgacggcgccgagcugcccuucaccaucgacaaguga

SEQ ID NO: 23842 - RNA, 1413 nt, Artificial Sequence
  derived and/or modified CDS sequence (AUadapt) from InfluenzaA__AEX33368__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcgccaucuccggcugggccaucuacaccaaggacaacucgauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcgcugaugagcugcccccugggggaggcccccuccccguacaacucgaaguucgagagcguggccugguccgccagcgcgugccacgacggcaugggcuggcucaccaucgggaucuccggccccgacaacggggccguggccguccugaaguacaacggcaucaucacggagaccaucaagucguggaagaagcgcauccugcggacccaggaguccgagugcgugugcgugaacggcagcugcuucaccaucaugacggacgggcccuccaacggcgccgccucguacaagaucuucaagaucgagaaggggaaggucaccaaguccaucgagcucaacgcgcccaacuuccacuacgaggagugcagcugcuacccggacaccggcaccgugaugugcgugugccgcgacaacuggcacggguccaaccggcccugggucucguucaaccagaaccuggacuaccagaucggcuacaucugcuccggcguguucggggacaacccccgccccaaggacggcgaggggagcugcaacccggugacggucgacggcgccgacggggugaagggcuucuccuacaaguacggcaacgggguguggaucggccggaccaagucgaaccgccugcggaagggguucgagaugaucugggaccccaacggcuggaccgacaccgacuccgacuucagcgucaagcaggacgugguggccaucacggacugguccggguacucgggcagcuucguccagcaccccgagcucaccggccuggacugcauccgccccugcuucuggguggagcugguccgggggcucccgcgcgagaacaccaccaucuggacguccggcucguccaucagcuucugcggggugaacuccgacaccgccaacuggagcuggcccgacggcgccgagcugcccuucaccaucgacaaguga

SEQ ID NO: 23843 - RNA, 1413 nt, Artificial Sequence
  derived and/or modified CDS sequence (AUadapt) from InfluenzaA__AEX33379__NA
augaaccccaaccagaagaucaucaccaucggcucgaucuccaucgccaucgggaucaucagccugaugcuccagaucggcaacaucaucuccaucugggccucgcacuccauccagaccgggauccagaaccacacgggcaucugcaaccagcgcaucaucaccuacgagaacagcaccugggugaaccacaccuacgucacgaucaacaacaccaacgugguggcggggaaggacaagaccuccgucacccuggccggcaacucgucccugugcagcaucuccggcugggccaucuacacgaaggacaacagcauccggaucggguccaagggcgacguguucgugauccgcgagccguucaucucgugcucccaccucgagugccggaccuucuuccugacccagggggcccugcucaacgacaagcacagcaacggcaccgucaaggaccgcucccccuaccgggcccugaugucgugcccccugggggaggcgcccuccccguacaacagcaaguucgagucgguggccugguccgccagcgccugccacgacggcaugggcuggcucacgaucgggaucuccggccccgacaacggggcgguggccguccugaaguacaacggcaucaucaccgagaccaucaagagcuggaagaagcgcauccugcggacccaggaguccgagugcgugugcgugaacggcucgugcuucacgaucaugaccgacgggcccuccaacggcgccgccagcuacaagaucuucaagaucgagaaggggaaggucaccaaguccaucgagcucaacgcccccaacuuccacuacgaggagugcucgugcuacccggacaccggcacggugaugugcgugugccgcgacaacuggcacggguccaaccggcccugggucagcuucaaccagaaccuggacuaccagaucggcuacaucugcuccggcguguucggggacaacccccgcccccgggacggcgaggggucgugcaacccggugaccgucgacggcgcggacggggugaagggcuucuccuacaaguacggcaacgggguguggaucggccgcaccaagagcaaccggcugcgcaagggguucgagaugaucugggaccccaacggcuggaccgacacggacuccgacuucagcgucaagcaggacgugguggccaucaccgacugguccggguacucgggcagcuucguccagcaccccgagcucaccggccuggacugcauccggcccugcuucuggguggagcugguccgcgggcucccgcgggagaacaccacgaucuggaccuccggcucguccaucagcuucugcggggugaacuccgacaccgccaacuggagcuggcccgacggcgccgagcugcccuucaccaucgacaaguga

SEQ ID NO: 23844 - RNA, 1413 nt, Artificial Sequence; identical to SEQ ID NO: 23843
  derived and/or modified CDS sequence (AUadapt) from InfluenzaA__AEX33390__NA

SEQ ID NO: 23845 - RNA, 1413 nt, Artificial Sequence; identical to SEQ ID NO: 23843
  derived and/or modified CDS sequence (AUadapt) from InfluenzaA__AEX33401__NA

SEQ ID NO: 23846 - RNA, 1413 nt, Artificial Sequence; identical to SEQ ID NO: 23843
  derived and/or modified CDS sequence (AUadapt) from InfluenzaA__AEX33412__NA

SEQ ID NO: 23847 - RNA, 1413 nt, Artificial Sequence; identical to SEQ ID NO: 23843
  derived and/or modified CDS sequence (AUadapt) from InfluenzaA__AEX33423__NA

SEQ ID NO: 23848 - RNA, 1413 nt, Artificial Sequence; identical to SEQ ID NO: 23843
  derived and/or modified CDS sequence (AUadapt) from InfluenzaA__AEX33434__NA

SEQ ID NO: 23849 - RNA, 1413 nt, Artificial Sequence; identical to SEQ ID NO: 23843
  derived and/or modified CDS sequence (AUadapt) from InfluenzaA__AEX33445__NA

SEQ ID NO: 23850 - RNA, 1410 nt, Artificial Sequence
  derived and/or modified CDS sequence (AUadapt) from InfluenzaA__AEX33544__NA
augaaccccaaccagaagaucaucaccaucggcucguucucccugaccaucgccgccaucugcuuccucaugcagaucgcgauccuggugacgaccgucacccugcacuucaagcagcacgagugcaacucgccgcccaacaaccaggugaugcucugcgagcccaccaucaucgagcgcaacaucacggagaucguguaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggucacccgggagcccuacguguccugcgaccccgacaagugcuaccaguucgcccugggccaggggaccacccugaacaacggccacagcaacgacacggugcacgaccgcaccccguaccggacccuccugaugaacgagcugggcguccccuuccaccucgggacccgccaggugugcaucgcgugguccucguccagcugccacgacggcaaggccuggcugcacgugugcgucacgggggacgacaagaacgccaccgccuccuucaucuacaacggccggcugguggacucgaucggguccuggagcaagaagauccuccgcacccaggaguccgagugcgugugcaucaacgggaccugcacggucgugaugaccgacggcucggcguccgggaaggccgacaccaagauccuguucaucgaggagggcaagaucgugcacaucagcacccugucgggguccgcccagcacgucgaggagugcucgugcuacccccgguaccccggcgugcgcugcgugugccgggacaacuggaagggcuccaaccgcccgaucgucgacaucaacgugaaggacuacagcaucguguccucguacgucugcuccgggcucgugggcgacacgccccggaagaacgacagcuucuccucgucccacugccuggaccccaacaacgaggagggcggccacggggugaagggcugggccuucgacgacggcaacgacgucuggauggggcgcaccaucagcgagaagcugcgguccggcuacgagaccuucaaggugaucgagggguggucgaagcccaacuccaagcuccagaucaaccgccaggucaucguggagcggggcaaccgcagcggguacuccggcaucuucucgguggagggcaaguccugcaucaaccggugcuucuacgucgagcugauccgcgggcggaaggagaagaccgaggugugguggacgagcaacucgaucguggucuucugcggcaccuccgggaccuacggcaccgggagcuggccggacggcgccgacaucaaccugaugcccaucuga

SEQ ID NO: 23851 - RNA, 1410 nt, Artificial Sequence; identical to SEQ ID NO: 17116
  derived and/or modified CDS sequence (AUadapt) from InfluenzaA__AEX33555__NA

SEQ ID NO: 23852 - RNA, 1410 nt, Artificial Sequence
  derived and/or modified CDS sequence (AUadapt) from InfluenzaA__AEX33610__NA
augaaccccaaccagaagaucaucaccaucggcucggugucccugaccaucagcacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgcccuucucgaaggacaacuccauccgccugagcgccggcggggacaucugggucacccgggagcccuacguguccugcgacccggacaagugcuaccaguucgcccucggccaggggaccacgcugaacaacgugcacucgaacgacaccguccacgaccgcacccccuaccggacccugcucaugaacgagcugggcgugcccuuccaccugggcacgaagcaggucugcaucgccugguccagcuccucgugccacgacgggaaggccuggcuccacgugugcgugaccggcgacgacaagaacgcgaccgccuccuucaucuacaacgggcgccugguggacagcaucgucuccuggucgaagaagauccugcggacccaggaguccgagugcgugugcaucaacggcacgugcaccguggucaugaccgacgggagcgccuccggcaaggccgacaccaagauccucuucaucgaggagggcaagaucgugcacacgucgacccugagcggguccgcgcagcacguggaggagugcucgugcuacccccgcuacccgggcguccggugcgugugccgcgacaacuggaagggguccaaccggcccaucguggacaucaacaucaaggacuacaacaucgucagcuccuacgugugcucgggccuggugggcgacacgccccgcaagaacgacuccagcuccucgucccacugccucgaccccaacaacgaggagggcgggcacggggucaagggcugggccuucgacgacgggaacgacguguggaugggccggaccaucagcgagaagcugcgcuccggcuacgagaccuucaaggucaucgggggcuggucgaacccgaacuccaagcugcagaucaaccgccaggugaucguggaccgggggaaccggagcggcuacuccgggaucuucucggucgagggcaaguccugcaucaaccgcugcuucuacguggagcucauccggggccgcaaggaggagaccgaggugcuguggaccagcaacucgaucgucguguucugcgggaccuccggcacguacgggaccggcagcuggcccgacggggccgacaucaaccugaugcccaucuga

SEQ ID NO: 23853 - RNA, 1410 nt, Artificial Sequence
  derived and/or modified CDS sequence (AUadapt) from InfluenzaA__AEX33828__NA
augaaccccaaccagaagaucaucaccaucggcucggugucccugaccaucagcacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgcccuucucgaaggacaacuccauccgccugagcgccggcggggacaucugggucacccgggagcccuacguguccugcgacccggacaagugcuaccaguucgcccucggccaggggaccacgcugaacaacgugcacucgaacgacaccguccacgaccgcacccccuaccggacccugcucaugaacgagcugggcgugcccuuccaccugggcacgaagcaggucugcaucgccugguccagcuccucgugccacgacgggaaggccuggcuccacgugugcgugaccggcgacgacaagaacgcgaccgccuccuucaucuacaacgggcgccugguggacagcaucgucuccuggucgaaggagauccugcggacccaggaguccgagugcgugugcaucaacggcacgugcaccguggucaugaccgacgggagcgccuccggcaaggccgacaccaagauccucuucaucgaggagggcaagaucgugcacacgucgacccugagcggguccgcgcagcacguggaggagugcagcugcuacccccgcuacccgggcguccggugcgugugccgcgacaacuggaagggguccaaccggcccaucguggacaucaacaucaaggacuacucgaucgucuccagcuacgugugcuccggccuggugggcgacacgccccgcaagaacgacucguccagcuccucgcacugccucgaccccaacaacgaggagggcgggcacggggucaagggcugggccuucgacgacgggaacgacguguggaugggccggaccaucuccgagaagcugcgcagcggcuacgagaccuucaaggucaucgaggggugguccaacccgaacucgaagcugcagaucaaccgccaggugaucguggaccggggcaaccgguccggguacagcggcaucuucuccgucgagggcaagucgugcaucaaccgcugcuucuacguggagcucauccgggggcgcaaggaggagaccgaggugcuguggaccagcaacuccaucgucguguucugcggcaccagcgggacguacggcaccggguccuggcccgacggcgccgacaucaaccugaugcccaucuga

SEQ ID NO: 23854 - RNA, 1410 nt, Artificial Sequence; identical to SEQ ID NO: 17114
  derived and/or modified CDS sequence (AUadapt) from InfluenzaA__AEX33839__NA

SEQ ID NO: 23855 - RNA, 1413 nt, Artificial Sequence
  derived and/or modified CDS sequence (AUadapt) from InfluenzaA__AEX33861__NA
augaaccccaaccagaagaucaucaccaucggcucgaucuccaucgccaucgggaccaucagccugaugcuccaggugggcaacaucaucuccaucugggccucgcacuccauccagacggggagccagaaccacaccggcaucugcaaccagcgcaucaucaccuacgagaacuccaccugggucaaccacacguacgugaacaucaacaacaccaacguggucgcggggaaggacaagaccucgguggcccuggccggcaacuccagccugugcuccaucucgggcugggccaucuacaccaaggacaacuccauccggaucgggagcaagggcgacguguucgucauccgcgagccguucaucuccugcucgcaccucgagugccggacguucuuccugacccagggggcccugcucaacgacaagcacuccaacggcaccgugaaggaccgcagccccuaccgggcgcugauguccugcccccugggggaggcccccucgccguacaacagcaaguucgaguccguggccuggagcgccuccgcgugccacgacggcaugggcuggcucaccaucgggaucucgggccccgacaacggggccgucgccgugcugaaguacaacggcaucaucacggagaccaucaaguccuggaagaagcgcauccugcggacccaggagagcgagugcgugugcgucaacggcuccugcuucaccaucaugacggacgggcccucgaacggcgccgccuccuacaagaucuucaagaucgagaagggccaggugaccaagagcguggagcucaacgcgcccaacuuccacuacgaggagugcuccugcuacccggacaccgggaccgucaugugcgugugccgcgacaacuggcacgggucgaaccggcccuggguguccuucaaccagaaccuggacuaccagaucggcuacaucugcagcggcgucuucggggacaacccccgccccaaggacggcaagggguccugcaacccggugacgguggacggcgccgacggggucaagggcuucucguacaaguacggcaacgggguguggaucggccggaccaaguccaaccgccugcggaagggguucgagaugaucugggaccccaacggcuggaccgacaccgacagcgacuucuccgugaagcaggacgucguggccaucacggacuggucgggguacagcggcuccuucguccagcaccccgagcucaccggccuggacugcauccgccccugcuucuggguggagcuggugcgggggcucccgcgcgagaacaccaccaucuggacgucgggcuccagcaucuccuucugcggggucgacagcgacaccgccaacugguccuggcccgacggcgccgagcugcccuucaccaucgacaaguga

SEQ ID NO: 23856 - RNA, 1410 nt, Artificial Sequence
  derived and/or modified CDS sequence (AUadapt) from InfluenzaA__AEX33872__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcagugcgagcccacgaucaucgagcgcaacaucaccgagaucguguaccugaccaacaccacgaucgagaaggagaucugccccaagcucgccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccugggccaggggaccacgcucaacaacgugcacuccaacgacaccguccacgaccgcaccccguaccggacccugcugaugaacgagcucggcgugcccuuccaccugggcacgaagcaggucugcaucgccuggagcuccucguccugccacgacgggaaggccuggcugcacgugugcgugaccggcgacgacaagaacgcgaccgccagcuucaucuacaacgggcgccucguggacuccaucgucucgugguccaaggagauccugcggacccaggagagcgagugcgugugcaucaacggcacgugcaccguggucaugaccgacggguccgccucgggcaaggccgacaccaagauccuguucaucgaggagggcaagaucgugcacacgagcacccucuccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccucgucccacugccugaaccccaacaacgaggagggcgggcacggggucaagggcugggccuucgacgacgggaacgacguguggaugggccggaccaucagcgagaagcuccgccugggcuacgagaccuucaaggucaucgaggggugguccaaccccaacucgaagcugcagaucaaccgccaggugaucguggaccggggcaaccgguccggguacagcggcaucuucuccgucgagggcaagucgugcaucaaccgcugcuucuacguggagcucauccgggggcgcaaggaggagaccgaggugcuguggaccagcaacuccaucgucguguucugcggcaccagcgggacguacggcaccggguccuggccggacggcgccgacaucaaccugaugcccaucuga

SEQ ID NO: 23857 - RNA, 1410 nt, Artificial Sequence; identical to SEQ ID NO: 17114
  derived and/or modified CDS sequence (AUadapt) from InfluenzaA__AEX33883__NA

SEQ ID NO: 23858 - RNA, 1410 nt, Artificial Sequence
  derived and/or modified CDS sequence (AUadapt) from InfluenzaA__AEX33894__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucgacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 23859 - RNA, 1413 nt, Artificial Sequence
  derived and/or modified CDS sequence (AUadapt) from InfluenzaA__AEX33916__NA
augaaccccaaccagaagaucaucaccaucggcucgaucuccaucgccaucgggaucaucagccugauccuccagaucggcaacaucaucuccaucugggccucgcacuccauccagaccgggagccagaaccacacgggcaucugcaaccagcgcaucaucaccuacgagaacuccaccugggugaacaacaccuacgucaacaucaacaacacgaacgugguggcggagaaggacaagaccucggucacccuggccgggaacuccagccugugcuccaucucgggcugggccaucuacaccaaggacaacuccauccggaucggcagcaagggggacguguucgugauccgcgagccguucaucuccugcucgcaccucgagugccggacguucuuccugacccagggcgcccugcucaacgacaagcacuccaacgggaccgucaaggaccgcagccccuaccgggcccugauguccugcccccugggcgaggcgcccucgccguacaacagccgcuucgaguccguggccuggucggccuccgccugccacgacgggaugggcuggcucaccaucggcaucagcgggcccgacaacggcgcgguggccguccugaaguacaacgggaucaucacggagaccaucaaguccuggaagaagcggauccugcgcacccaggagucggagugcgugugcaugaacggcuccugcuucaccaucaugacggacggccccagcaacggggccgccuccuacaagaucuucaagaucgagaagggcaaggugaccaagaccaucgagcucaacgcccccaacuuccacuacgaggagugcucgugcuacccggacaccgggacggucaugugcgugugccgggacaacuggcacggcuccaaccgccccugggugagcuucaaccagaaccuggacuaccagaccggguacaucugcuccggcgucuucggcgacaacccccggcccaaggacggggagggcucgugcaacccgaugaccguggacggggcggacggcgugaagggguucuccuacaaguacggcaacggcgucuggaucgggcgcaccaagagcaaccggcugcgcaagggcuucgagaugaucugggaccccaacggguggacgaacaccgacuccgacuucucggugaagcaggacguggucgccaucaccgacugguccggcuacagcgggucguucgugcagcaccccgagcucaccggccuggacugcauccggcccugcuucuggguggagcugguccgcggccucccgcgggagaacacgaccaucuggaccuccgggagcuccaucucguucugcggcgugaacuccgggaccgccaacuggagcuggcccgacggcgccgagcugcccuucacgaucgacaaguga

SEQ ID NO: 23860 - RNA, 1413 nt, Artificial Sequence; identical to SEQ ID NO: 18271
  derived and/or modified CDS sequence (AUadapt) from InfluenzaA__AEX33927__NA

SEQ ID NO: 23861 - RNA, 1413 nt, Artificial Sequence
  derived and/or modified CDS sequence (AUadapt) from InfluenzaA__AEX33938__NA
augaaccccaaccagaagaucaucaccaucggcucgaucuccaucgccaucgggaucaucagccugauccuccagaucggcaacaucaucuccaucugggccucgcacuccauccagaccgggagccagaaccacacgggcaucugcaaccagcgcaucaucaccuacgagaacuccaccugggugaacaacaccuacgucaacaucaacaacacgaacgugguggucgagaaggacaagaccucggugacccuggcggggaacuccagccugugcuccaucagcggcugggccaucuacaccaaggacaacuccauccggaucggcucgaagggggacguguucgucauccgcgagccguucaucuccugcagccaccucgagugccggacguucuuccugacccagggcgcccugcucaacgacaagcacuccaacgggaccgugaaggaccgcucgcccuaccgggcccugauguccugcccccugggcgaggcccccagcccguacaacucgcgcuucgaguccguggcguggagcgccuccgccugccacgacgggaugggcuggcucaccaucggcaucagcgggcccgacaacggcgccgucgcggugcugaaguacaacgggaucaucacggagaccaucaaguccuggaagaagcggauccugcgcacccaggagucggagugcgugugcaugaacggcuccugcuucaccaucaugacggacggccccagcaacggggccgccuccuacaagaucuucaagaucgagaagggcaaggucaccaagaccaucgagcucaacgcccccaacuuccacuacgaggagugcucgugcuacccggacaccgggacggugaugugcgugugccgggacaacuggcacggcuccaaccgccccugggucagcuucaaccagaaccuggacuaccagaucggguacaucugcuccggcguguucggcgacaacccccggcccaaggacggggagggcucgugcaacccggugaccgucgacggggccgacggcgugaagggguucuccuacaaguacggcaacggcguguggaucgggcgcaccaagagcaaccggcugcgcaagggcuucgagaugaucugggaccccaacggguggaccaacacggacuccgacuucagcgucaagcaggacgugguggcgaucaccgacugguccggcuacucggggagcuucguccagcaccccgagcucaccggccuggacugcauccggcccugcuucuggguggagcugguccgcggccucccgcgggagaacaccacgaucuggaccuccgggucguccaucagcuucugcggcgugaacuccgggaccaccaacuggagcuggcccgacggcgccgagcugcccuucacgaucgacaaguga

SEQ ID NO: 23862 - RNA, 1413 nt, Artificial Sequence
  derived and/or modified CDS sequence (AUadapt) from InfluenzaA__AEX33949__NA
augaaccccaaccagaagaucaucaccaucggcucgaucuccaucgccaucgggaucaucagccugauccuccagaucggcaacaucaucuccaucugggccucgcacuccauccagaccgggagccagaaccacacgggcaucugcaaccagcgcaucaucaccuacgagaacuccaccugggugaacaacaccuacgucaacaucaacaacacgaacgugguggucgagaaggacaagaccucggugacccuggcggggaacuccagccugugcuccaucagcggcugggccaucuacaccaaggacaacuccauccggaucggcucgaagggggacguguucgucauccgcgagccguucaucuccugcagccaccucgagugccggacguucuuccugacccagggcgcccugcucaacgacaagcacuccaacgggaccgugaaggaccgcucgcccuaccgggcccugauguccugcccccugggcgaggcccccagcccguacaacucgcgcuucgaguccguggcguggagcgccuccgccugccacgacgggaugggcuggcucaccaucggcaucagcgggcccgacaacggcgccgucgcggugcugaaguacaacgggaucaucacggagaccgugaaguccuggaagaagcggauccugcgcacccaggagucggagugcgucugcaugaacggcuccugcuucaccaucaugacggacggccccagcaacggggccgccuccuacaagaucuucaagaucgagaagggcaaggugaccaagaccaucgagcucaacgcccccaacuuccacuacgaggagugcucgugcuacccggacaccgggacggugaugugcgucugccgggacaacuggcacggcuccaaccgccccugggugagcuucaaccagaaccuggacuaccagaucggguacaucugcuccggcguguucggcgacaacccccggcccaaggacggggagggcucgugcaacccggucaccguggacggggccgacggcgugaagggguucuccuacaaguacggcaacggcgucuggaucgggcgcaccaagagcaaccggcugcgcaagggcuucgagaugaucugggaccccaacggguggaccaacacggacuccgacuucagcgugaagcaggacguggucgcgaucaccgacugguccggcuacucggggagcuucgugcagcaccccgagcucaccggccuggacugcauccggcccugcuucugggucgagcuggugcgcggccucccgcgggagaacaccacgaucuggaccuccgggucguccaucagcuucugcggcgugaacuccgggaccgccaacuggagcuggcccgacggcgccgagcugcccuucaccaucgacaaguga

SEQ ID NO: 23863 - RNA, 1410 nt, Artificial Sequence
  derived and/or modified CDS sequence (AUadapt) from InfluenzaA__AEX33971__NA
augaaccccaaccagaagaucaucaccaucggcucggugucccugaccaucucgacgaucugcuucuucaugcagaucgccauccucaucaccaccgucacccugcacuucaagcaguacgaguucuccagcccgcccaacaaccaggugaugcugugcgagcccgccaucaucgagcgcaacaucacggagaccguguaccucaccaacaccacgaccgagaaggagaucugccccaagcuggcggaguaccggaacugguccaagccgcagugcgacaucaccggguucgcccccuucucgaaggacaacuccauccgccugagcgccggcggggacaucugggucacccgggagcccuacguguccugcgaccccgacaagugcuaccaguucgcccucggccaggggacgacccugaacaacgugcacucgaacgacaccguccacgaccgcaccccguaccggacgcugcucaugaacgagcugggcgugcccuuccaccugggcaccaagcaggucugcaucgccugguccagcuccucgugccacgacgggaaggcguggcuccacgugugcgugaccggcgacgacaagaacgccaccgccuccuucaucuacaacgggcgccugguggacagcaucgucuccuggucgaaggagauccugcggacgcaggaguccgagugcgugugcaucaacgggaccugcaccguggucaugaccgacgggagcgccucgggcaaggcggacacgaagauccucuucaucgaggagggcaagaucgugcacaccuccacccugagcggguccgcccagcacguggaggagugcucgugcuacccccgcuaccccggcguccggugcgugugccgcgacaacuggaagggguccaaccggccgaucguggacaucaacaucaaggacuacagcaucgucucccgcuacgugugcucgggcaucgugggcgacacgccccggaagaacgacuccagcuccucgucccacugccuggaccccaacaacgaggagggcggccacggggucaagggcugggccuucgacgacgggaacgacguguggaugggccgcaccaucagcgagaagucccggucgggcuacgagaccuucaaggucaucgaggggugguccaaccccaacagcaagcuccagaucaaccgccaggugaucguggaccggggcaaccgcuccggguacucgggcaucuucagcgucgaggggaaguccugcaucaaccggugcuucuacguggagcugauccgcggccggaaggaggagaccgaggugcuguggaccucgaacuccaucgucguguucugcggcacgagcgggaccuacggcaccggguccuggccggacggcgccgacaucaaccucaugcccaucuga

SEQ ID NO: 23864 - RNA, 1410 nt, Artificial Sequence
  derived and/or modified CDS sequence (AUadapt) from InfluenzaA__AEX33993__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcgaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccguguga

SEQ ID NO: 23865 - RNA, 1410 nt, Artificial Sequence; identical to SEQ ID NO: 18914
  derived and/or modified CDS sequence (AUadapt) from InfluenzaA__AEX34026__NA

SEQ ID NO: 23866 - RNA, 1410 nt, Artificial Sequence
  derived and/or modified CDS sequence (AUadapt) from InfluenzaA__AEX34036__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugucggccggcggggacaucugggucacccgggagcccuacguguccugcgaccccgacaagugcuaccaguucgcccucggccaggggaccacgcugaacaacgugcacagcaacgacaccguccacggccgcaccccguaccggacccugcucaugaacgagcugggcgugcccuuccaccuggggacgaagcaggucugcaucgccugguccucguccagcugccacgacggcaaggccuggcuccacgugugcgugaccggggacgacaagaacgcgaccgccuccuucaucuacaacggccgccugguggacagcaucgucuccuggucgaaggagauccugcggacccaggaguccgagugcgugugcaucaacgggacgugcgccguggucaugaccgacggcagcgccucgggcaaggcggacaccaagauccucuucaucgaggaggggaagaucgugcacaccuccacgcugagcggcuccgcccagcacguggaggagugcucgugcuacccccgcuaccccgggguccggugcgugugccgcgacaacuggaagggcuccaaccggccgaucguggacaucaacaucaaggacuacagcaucgucucccgcuacgugugcucgggccuggugggggacacgccccggaagaacgacuccagcuccagcucccacugccucgaccccaacaacgaggagggcgggcacggcgucaaggggugggccuucgacgacggcgacgacguguggaugggccgcaccaucucggagaagucccggagcggguacgagaccuucaaggucaucgagggcugguccaaccccaacucgaagcugcagaucaaccgccaggugaucguggaccgggggaaccgcuccggcuacagcgggaucuucucggucgagggcaaguccugcaucaaccggugcuucuacguggagcugauccgcggccggaaggaggagaccgaggugcucuggaccagcaacuccaucgucguguucugcgggaccagcggcaccuacgggacgggcuccuggccggacggggccgacaucaaccugaugcccaucuga

SEQ ID NO: 23867 - RNA, 1410 nt, Artificial Sequence
  derived and/or modified CDS sequence (AUadapt) from InfluenzaA__AEX34058__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccgccaucaucgagcgcaacaucacggagaucguguaccucaccaacaccaccaucgagaaggagaucugccccaagcugacggaguaccggaacugguccaagccgcagugcgacaucaccggguucgcgcccuucagcaaggacaacuccauccgccugucggccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccucguccagcugccacgacgggaaggccuggcuccacgugugcgugaccggcgacgacaagaacgcgaccgccuccuucaucuacaacgggcgccugguggacagcaucgucuccuggucgaaggagauccugcggacccaggaguccgagugcgugugcaucaacggcacgugcaccguggucaugaccgacgggagcgccucgggcaaggccgacaccaagauccucuucaucgaggagggcaagaucgugcacacguccacccugagcggguccgcgcagcacguggaggagugcucgugcuacccccgcuaccccggcguccggugcgugugccgcgacaacuggaagggguccaaccggccgaucguggacaucaacaucaaggacuacagcaucgucucccgcuacgugugcucgggccuggugggcgacacgccccggaagaacgacuccagcuccagcucccacugccucgaccccaacaacgaggagggcgggcacggggucaagggcugggccuucgacgacgggaacgacguguggaugggccgcaccaucucggagaagucccggagcggcuacgagaccuucaaggucaucgaggggugguccaaccccaacucgaagcugcagaucaaccgccaggugaucguggaccggggcaaccgcuccggguacagcggcaucuucucggucgaggggaaguccugcaucaaccggugcuucuacguggagcugauccgcggccggaaggaggagaccgaggugcucuggaccagcaacuccaucgucguguucugcggcaccagcgggacguacggcaccggguccuggccggacggcgccgacaucaaccugaugcccaucuga

SEQ ID NO: 23868 - RNA, 1410 nt, Artificial Sequence
  derived and/or modified CDS sequence (AUadapt) from InfluenzaA__AEX34103__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccacgaucaucgagcgcaacaucaccgagaucguguaccucaccaacaccacgaucgagaaggaggucugccccaagcuggccgaguaccggaacugguccaagccgcagugcgacaucaccggguucgcgcccuucagcaaggacaacuccauccgccugucggccggcggggacaucugggugacccgggagcccuacguguccugcgaccccgacaagugcuaccaguucgcccucggccaggggaccacgcugaacaacguccacagcaacgacaccgugcacgaccgcaccccguaccggacccugcucaugaacgagcugggcgugcccuuccaccugggcacgaagcaggucugcaucgccugguccucguccagcugccacgacgggaaggccuggcuccacgugugcgugaccggcgacgacaagaacgcgaccgccuccuucaucuacaacgggcgccuggucgacucgaucguguccuggagcaaggagauccugcggacccaggaguccgagugcgugugcaucaacggcacgugcaccgucgugaugaccgacgggucggccagcggcaaggccgacaccaagauccucuucaucgaggagggcaagaucgugcacacguccacccugucggggaacgcgcagcacgucgaggagugcuccugcuacccccgcuaccccggcgugcggugcgugugccgcgacaacuggaaggggagcaaccggccgaucgucgacaucaacaucaaggacuacuccaucgugucgcgcuacgugugcuccggccuggucggcgacacgccccggaagaacgacagcuccucguccagccacugccucgaccccaacaacgaggagggcgggcacggggugaagggcugggccuucgacgacgggaacgacgucuggaugggccgcaccaucuccgagaagucccggucgggcuacgagaccuucaaggugaucgagggguggagcaaccccaacuccaagcugcagaucaaccgccaggugaucgucgaccggggcaaccgcucgggguacuccggcaucuucagcguggagggcaagucgugcaucaaccggugcuucuacguggagcugauccgcgggcggaaggaggagaccaagguccucuggaccuccaacagcaucgugguguucugcggcaccuccgggacguacggcaccgggagcuggccggacggcgccgacaucaaccugaugcccaucuga

SEQ ID NO: 23869 - RNA, 1410 nt, Artificial Sequence
  derived and/or modified CDS sequence (AUadapt) from InfluenzaA__AEX34114__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccgccaucaucgagcgcaacaucacggagaucguguaccccaccaacaccaccaucgagaaggagaucugcccgaagcucgcggaguaccggaacugguccaagccccagugcgacaucacgggguucgcccccuucagcaaggacaacuccauccgccugucggccggcggggacaucugggucacccgggagcccuacguguccugcgacccggacaagugcuaccaguucgcccugggccaggggaccacccucaacaacgugcacagcaacgacacgguccacgaccgcacccccuaccggacccugcugaugaacgagcucggcgugcccuuccaccugggcaccaagcaggucugcaucgccugguccucguccagcugccacgacgggaaggcguggcugcacgugugcgugacgggcgacgacaagaacgccaccgccuccuucaucuacaacgggcgccucguggacucgaucgucuccuggagcaaggagauccugcggacccaggaguccgagugcgugugcaucaacgggaccugcacgguggucaugaccgacgggucggccagcggcaaggcggacaccaagauccuguucaucgaggagggcaagaucgugcacaccuccacgcucucgggguccgcccagcacguggaggagugcagcugcuacccccgcuacccgggcguccggugcgugugccgcgacaacuggaagggguccaaccggcccaucguggacaucaacaucaaggacuacucgaucgucucccgcuacgugugcagcggccuggugggcgacacgccccggaagaacgacuccucguccagcucccacugccuggaccccaacaacgaggagggcggccacggggucaagggcugggccuucgacgacgggaacgacguguggaugggccgcaccaucucggagaagucccggagcggcuacgagaccuucaaggucaucgaggggugguccaacccgaacucgaagcuccagaucaaccgccaggugaucguggaccggggcaaccgcuccggguacagcggcaucuucucggucgaggggaaguccugcaucaaccggugcuucuacguggagcugauccgcggccggaaggaggagaccgaggugcuguggaccagcaacuccaucgucguguucugcggcaccagcgggaccuacggcacgggguccuggcccgacggcgccgacaucaaccucaugcccaucuga

SEQ ID NO: 23870 - RNA, 1410 nt, Artificial Sequence
  derived and/or modified CDS sequence (AUadapt) from InfluenzaA__AEX34137__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcggccggaccccguaccgcacccugcucaugaacgagcugggcgugcccuuccaccuggggacgaagcaggucugcaucgccuggagcuccucguccugccacgacggcaaggccuggcuccacgugugcaucaccggggacgacaagaacgcgaccgccagcuucaucuacaacggccggcugguggacuccaucgugucgugguccaaggagauccugcgcacccaggagagcgagugcgucugcaucaacgggacgugcaccguggugaugaccgacggcuccgccucgggcaaggccgacaccaagauccucuucaucgaggaggggaagaucguccacacgagcacccuguccggcucggcgcagcacguggaggagugcuccugcuacccccgguaccccggggugcgcugcgucugccgggacaacuggaagggcagcaaccgcccgaucguggacaucaacaucaaggaccacuccaucgugucguccuacgucugcagcggccuggugggggacacgccccggaagaacgacuccucguccagcucccacugccucgaccccaacaacgaggagggcgggcacggcgugaaggggugggccuucgacgacggcaacgacgucuggaugggccgcaccaucucggagaagucccggcugggguacgagaccuucaaggugaucgagggcuggagcaaccccaaguccaagcugcagaucaaccgccaggucaucguggaccgggggaaccgcucgggcuacuccgggaucuucagcguggagggcaagucgugcaucaaccggugcuucuacgucgagcucauccgcggccggaaggaggagaccgaggugcuguggaccuccaacagcaucguggucuucugcgggaccuccggcacguacgggaccggcagcuggccggacggggccgacaucaaccugaugcccaucuga

SEQ ID NO: 23871 - RNA, 1410 nt, Artificial Sequence
  derived and/or modified CDS sequence (AUadapt) from InfluenzaA__AEX34191__NA
augaaccccaaccagaagaucaucaccaucggcucggugucccugagcaucuccaccaucugcuucuucaugcagaucgccauccucaucacgaccgucacccugcacuucaagcaguacgaguucaacucguccccgaacaaccaggugaugcugugcgagcccaccaucaucgagcgcaacaucacggagaucguguaccucaccaacaccaccaucgagaaggagaucugccccaagcuggccgaguaccggaacuggagcaagccccagugcgacaucacgggguucgcgccguucuccaaggacaacucgauccgccuguccgccggcggggacaucugggucacccgggagcccuacgugagcugcgaccccgacaagugcuaccaguucgcccucggccaggggaccacccugaacaacgugcacuccaacaacacgguccgcgaccggacccccuaccgcacccugcucaugaacgagcugggcgugccguuccaccugggcaccaagcaggucugcaucgccuggagcuccucguccugccacgacgggaaggccuggcuccacgugugcaucacgggcgacgacaagaacgcgaccgccagcuucaucuacaacgggcggcugguggacuccaucgugucgugguccaaggagauccugcgcacccaggagagcgagugcgucugcaucaacgggaccugcacgguggugaugaccgacgggucggccuccggcaaggccgacaccaagauccucuucaucgaggagggcaagaucguccacaccagcacgcuguccgggagcgcgcagcacguggaggagugcuccugcuacccccgguaccccggcgugcgcugcgucugccgggacaacuggaaggggucgaaccgccccaucguggacaucaacaucaaggaccacuccaucgugagcuccuacgucugcucgggccuggugggcgacaccccgcggaagaacgacuccagcuccucgucccacugccucgaccccaacaacgaggagggcggccacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcucgggguacagcggcaucuucuccguggagggcaagucgugcaucaaccggugcuucuacgucgagcucauccgcgggcggaaggaggagacggaggugcuguggaccuccaacagcaucguggucuucugcggcaccuccgggaccuacggcacggggagcuggcccgacggcgccgacaucaaccugaugccgaucuga

SEQ ID NO: 23872 - RNA, 1410 nt, Artificial Sequence
  derived and/or modified CDS sequence (AUadapt) from InfluenzaA__AEX34224__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugucggccggcggggacaucugggucacccgggagcccuacguguccugcgaccccgacaagugcuaccaguucgcccucggccaggggaccacgcugaacaacgugcacagcaacgacaccguccacggccgcaccccguaccggacccugcucaugaacgagcugggcgugcccuuccaccuggggacgaagcaggucugcaucgccugguccucguccagcugccacgacggcaaggccuggcuccacgugugcgugaccggggacgacaagaacgcgaccgccuccuucaucuacaacggccgccugguggacagcaucgucuccuggucgaaggagauccugcggacccaggaguccgagugcgugugcaucaacgggacgugcaccguggucaugaccgacggcagcgccucgggcaaggccgacaccaagauccucuucaucgaggaggggaagaucgugcacacguccacccugagcggcuccgcgcagcacguggaggagugcucgugcuacccccgcuaccccgggguccggugcgugugccgcgacaacuggaagggcuccaaccggccgaucguggacaucaacaucaaggacuacagcaucgucucccgcuacgugugcucgggccuggugggggacacgccccggaagaacgacuccagcuccagcucccacugccucgaccccaacaacgaggagggcgggcacggcgucaaggggugggccuucgacgacggcaacgacguguggaugggccgcaccaucucggagaagcugcgguccggguacgagaccuucaaggucaucgagggcuggagcaaccccaacuccaagcugcagaucaaccgccaggugaucguggaccgggggaaccgcucgggcuacuccgggaucuucagcgucgagggcaagucgugcaucaaccggugcuucuacguggagcucauccgcggccggaaggaggagaccgaggugcuguggaccuccaacagcaucgucguguucugcgggaccuccggcacguacgggaccggcagcuggccggacggggccgacaucaaccugaugcccaucuga

SEQ ID NO: 23873 - RNA, 1410 nt, Artificial Sequence
  derived and/or modified CDS sequence (AUadapt) from InfluenzaA__AEX34235__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccgccaucaucgagcgcaacaucacggagaucguguaccucaccaacaccaccaucgagaaggagaucugccccaagcuggcggaguaccggaacugguccaagccgcagugcgacaucacgggguucgcccccuucagcaaggacaacuccauccgccugucggccggcggggacaucugggucacccgggagcccuacguguccugcgaccccgacaagugcuaccaguucgcccucggccaggggaccacccugaacaacgugcacagcaacgacacgguccacgaccgcaccccguaccggacccugcucaugaacgagcugggcgugcccuuccaccugggcaccaagcaggucugcaucgccugguccagcuccucgugccacgacgggaaggcguggcuccacgugugcgugacgggcgacgacaagaacgccaccgccuccuucaucuacaacgggcgccugguggacagcaucgucuccuggucgaaggagauccugcggacccaggaguccgagugcgugugcaucaacgggaccugcacgguggucaugaccgacgggagcgccucgggcaaggcggacaccaagauccucuucaucgaggagggcaagaucgugcacaccuccacgcugagcggguccgcccagcacguggaggagugcagcugcuacccccgcuaccccggcguccggugcgugugccgcgacaacuggaagggguccaaccggccgaucguggacaucaacaucaaggacuacucgaucgucucccgcuacgugugcagcggccuggugggcgacacgccccggaaguccgacucguccagcuccucgcacugccucgaccccaacaacgaggagggcggccacggggucaagggcugggccuucgacgacgggaacgacguguggaugggccgcaccaucuccgagaagucccggagcggcuacgagaccuucaaggucaucgagggguggagcaaccccaacuccaagcugcagaucaaccgccaggugaucguggaccggggcaaccgcucgggguacagcggcaucuucuccgucgagggcaagucgugcaucaaccggugcuucuacguggagcugauccgcgggcggaaggaggagaccgaggugcucuggaccuccaacagcaucgucguguucugcggcaccuccgggaccuacggcacggggagcuggccggacggcgccgacaucaaccugaugcccaucuga

SEQ ID NO: 23874 - RNA, 1410 nt, Artificial Sequence
  derived and/or modified CDS sequence (AUadapt) from InfluenzaA__AEX34246__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcggccggaccccguaccgcacccugcucaugaacgagcugggcgugcccuuccaccuggggacgaagcaggucugcaucgccuggagcuccucguccugccacgacggcaaggccuggcuccacgugugcaucaccggggacgacaagaacgcgaccgccagcuucaucuacaacggccggcugguggacuccaucgugucgugguccaaggagauccugcgcacccaggagagcgagugcgucugcaucaacgggacgugcaccguggugaugaccgacggcuccgccucgggcaaggccgacaccaagauccucuucaucgaggaggggaagaucguccacacgagcacccuguccggcucggcgcagcacguggaggagugcuccugcuacccccgguaccccggggugcgcugcgucugccgggacaacuggaagggcagcaaccgcccgaucguggacaucaacaucaaggaccacuccaucgugucguccuacgucugcagcggccuggugggggacacgccccggaagaacgacuccucguccagcucccacugccucgaccccaacaacgaggagggcgggcacggcgugaaggggugggccuucgacgacggcaacgacgucuggaugggccgcaccaucucggagaagucccggcugggguacgagaccuucaaggugaucgagggcuggagcaaccccaaguccaagcugcaggucaaccgccaggugaucguggaccgggggaaccgcucgggcuacuccgggaucuucagcgucgagggcaagucgugcaucaaccggugcuucuacguggagcucauccgcggccggaaggaggagaccgaggugcuguggaccuccaacagcaucgucguguucugcgggaccuccggcacguacgggaccggcagcuggccggacggggccgacaucaaccugaugcccaucuga

SEQ ID NO: 23875 - RNA, 1410 nt, Artificial Sequence
  derived and/or modified CDS sequence (AUadapt) from InfluenzaA__AEX34257__NA
augaaccccaaccagaagaucaucaccaucggcucggugucccugaccaucagcacgaucugcuucuucaugcagaucgccauccucaucaccaccgucacccugcacuucaagcaguacgaguucaacuccucgccgaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgccguucagcaaggacaacuccauccgccugucggccggcggggacaucugggucacccgggagcccuacguguccugcgaccccgacaagugcuaccaguucgcccucggccaggggaccacgcugaacaacgugcacagcaacaacaccguccgcaaccggacccccuaccgcacccugcucaugaacgagcugggcgugccguuccaccugggcacgaagcaggucugcaucgccugguccucguccagcugccacgacgggaaggccuggcuccacgugugcaucaccggcgacgacaagaacgcgaccgccuccuucaucuacaacgggcggcugguggacagcaucguguccuggucgaaggagauccugcgcacccaggaguccgagugcgucugcaucaacggcacgugcaccguggugaugaccgacgggagcgccucgggcaaggccgacaccaagauccucuucaucgaggagggcaagaucguccacacguccacccugagcggguccgcgcagcacguggaggagugcucgugcuacccccgguaccccggcgugcgcugcgucugccgggacaacuggaagggguccaaccgccccaucguggacaucaacaucaaggaccacagcaucguguccucguacgucugcuccggccuggugggcgacaccccgcggaagaacgacagcuccagcuccucgcacugccucgaccccaacaacgaggagggcgggcacggggugaagggcugggccuucgacgacgggaacgacgucuggaugggccgcaccaucuccgagaagucccggcugggcuacgagacguucaaggugaucgagggguggagcaaccccaagucgaagcugcagaucaaccgccaggucaucguggaccggggcaaccgcuccggguacagcggcaucuucucgguggaggggaaguccugcaucaaccggugcuucuacgucgagcucauccgcggccggaaggaggagaccgaggugcuguggaccagcaacuccaucguggucuucugcggcaccagcgggacguacggcaccggguccuggcccgacggcgccgacaucaaccugaugccgaucuga

SEQ ID NO: 23876 - RNA, 1410 nt, Artificial Sequence
  derived and/or modified CDS sequence (AUadapt) from InfluenzaA__AEX34268__NA
augaaccccaacaagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcaaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcaagcuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccuccgggaccuacggcacggggagcuggccggacggcgccgacaucaaccugaugcccaucuga

SEQ ID NO: 23877 - RNA, 1410 nt, Artificial Sequence
  derived and/or modified CDS sequence (AUadapt) from InfluenzaA__AEX34278__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccgccaucaucgagcgcaacaucacggagaucguguaccucaccaacaccaccaucgagaaggagaucugccccaagcuggcggaguaccggaacugguccaagccgcagugcgacaucacgggguucgcccccuucagcaaggacaacuccauccgccugucggccggcggggacaucugggucacccgggagcccuacguguccugcgaccccgacaagugcuaccaguucgcccucggccaggggaccacccugaacaacgugcacagcaacgacacgguccacgaccgcaccccguaccggacccugcucaugaacgagcugggcgugcccuuccaccugggcaccaagcaggucugcaucgccugguccucguccagcugccacgacgggaaggcguggcuccacgugugcgugacgggcgacgacaagaacgccaccgccuccuucaucuacaacgggcgccugguggacagcaucgucuccuggucgaaggagauccugcggacccaggaguccgagugcgugugcaucaacgggaccugcacgguggucaugaccgacgggagcgccucgggcaaggcggacaccaagauccucuucaucgaggagggcaagaucgugcacaccuccacgcugagcggguccgcccagcacguggaggagugcucgugcuacccccgcuaccccggcguccggugcgugugccgcgacaacuggaagggguccaaccggccgaucguggacaucaacaucaaggacuacagcaucgucucccgcuacgugugcucgggccuggugggcgacacgccccggaagaacgacuccagcuccagcucccacugccucgaccccaacaacgagaagggcggccacggggucaagggcugggccuucgacgacgggaacgacguguggaugggccgcaccaucucggagaagucccggagcggcuacgagaccuucaaggucaucgaggggugguccaaccccaacucgaagcugcagaucaaccgccaggugaucguggaccggggcaaccgcuccggguacagcggcaucuucucggucgaggggaaguccugcaucaaccggugcuucuacguggagcugauccgcggccggaaggaggagaccgaggugcucuggaccagcaacuccaucgucguguucugcggcaccagcgggaccuacggcacgggguccuggccggacggcgccgacaucaaccugaugcccaucuga

SEQ ID NO: 23878 - RNA, 1413 nt, Artificial Sequence
  derived and/or modified CDS sequence (AUadapt) from InfluenzaA__AEX34310__NA
augaaccccaaccagaagaucaucaccaucggcucgaucuccaucgccaucgggaucaucagccugaugcuccagaucggcaacaucaucuccaucugggccucgcacuccauccagaccgggacgcagaaccacaccggcaucugcaaccagcgcaucaucaccuacgagaacagcaccugggugaaccacacguacgucaacaucaacaacaccaacgugguggcggggaaggacaagaccccggucacccuggugggcaacuccucgcugugcuccaucagcggcugggccaucuacacgaaggacaacuccauccggaucgggucgaagggcgacguguucgucauccgcgagcccuucaucuccugcagccaccucgagugcaagaccuucuuccugacccagggggcccugcucaacgacaagcacuccaacggcaccgugaaggaccggagccccuaccgcgcccugauguccugcccccugggggaggccccgucgcccuacaacuccaaguucgagagcguggcguggucggccuccgccugccacgacggcaucggcuggcucacgaucgggaucagcggccccgacaacggggccgucgcggugcugaaguacaagggcaucaucaccggcaccaucaaguccuggaagaagcagauccugcggacccaggagucggagugcgugugcaugaacggguccugcuucacgaucaugaccgacggccccagcaacggggccgccuccuacaagaucuucaagaucgagaagggcaaggucaccaagucgauggagcucaacgccccgaacuuccacuacgaggagugcuccugcuaccccgacaccgggacggugaugugcgugugccgcgacaacuggcacggcagcaaccggcccugggucuccuucaaccagaaccuggacuaccagaucggcuacaucugcagcgggguguucggcgacaacccccgcccgaaggaccgggagggguccugcaaccccgugaccgucgacggcgccaacggggugaagggcuucucguacaaguacggcaacgggguguggaucggccgcaccaaguccaaccggauccgcaagggguucgagaugaucugggaccccaacggcuggaccaacacggacagcgacuucuccgucaagcaggacaucguggcgaucaccgacuggucgggguacuccggcagcuucgugcagcaccccgagcugaccggccucgacugcauccggccgugcuucugggucgagcuggugcgcgggcugcccggcgagaacaccacgaucuggaccucgggguccagcaucuccuucugcggcgucaacggcgacaucgccaacuggagcuggcccgacggggccgagcuccccuucaccaucgacaaguga

SEQ ID NO: 23879 - RNA, 1413 nt, Artificial Sequence
  derived and/or modified CDS sequence (AUadapt) from InfluenzaA__AEX34321__NA
augaaccccaaccagaagaucaucaccaucggcucgaucuccaucgccaucgggaucaucagccugaugcuccagaucggcaacaucaucuccaucugggugagccacuccauccagaccgggucgcagaacaacacgggcaucugcaaccagcgcaucaucaccuacgagaacuccaccugggucaaccacaccuacgugaacaucaacaacacgaacguggucgccggggaggacaagaccagcgugacccuggcgggcaacuccagccugugcuccaucucgggcugggccaucuacaccaaggacaacuccauccggaucgggagcaagggcgacguguucgucauccgcgagccguucaucuccugcagccaccucgagugccggacguucuuccugacccagggggcccugcucaacgacaagcacuccaacggcaccgugaaggaccgcucgcccuaccgggcccugauguccugcccccugggggaggcccccagcccguacaacagcaaguucgaguccguggcguggagcgccuccgccugccacgacggcaugggcuggcucaccaucgggaucucgggccccgacaacggggccgucgcggugcugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggucaccaagucgaucgagcucaacgcccccaacuucuacuacgaggagugcuccugcuacccggacaccggcaucgugaugugcgugugccgggacaacuggcacgggagcaaccgccccugggucuccuucaaccagaaccuggacuaccagaucggcuacaucugcagcggcguguucggggacaacccccggcccgaggacggcgagggguccugcaacccggugaccgucgacggcgccaacggggugaagggcuucucguacaaguacggcaacgggguguggaucggccgcacgaaguccaaccggcugcgcaagggguucgagaugaucugggaccccaacggcuggaccaacaccgacagcgacuucuccgucaagcaggacgugguggcgaucaccgacuggagcggguacucgggcuccuucguccagcaccccgagcucacgggccuggacugcauccggcccugcuucuggguggagcugguccgcgggcucccgcgggagaacaccaccaucuggaccagcggcuccagcaucuccuucugcggggugaacagcgacacggccaacugguccuggcccgacggcgccgagcugcccuucaccaucgacaaguga

SEQ ID NO: 23880 - RNA, 1410 nt, Artificial Sequence; identical to SEQ ID NO: 18459
  derived and/or modified CDS sequence (AUadapt) from InfluenzaA__AEX34356__NA

SEQ ID NO: 23881 - RNA, 1410 nt, Artificial Sequence
  derived and/or modified CDS sequence (AUadapt) from InfluenzaA__AEX34367__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccaucgugagcugguccaaggagauccugcgcacccaggagucggagugcgucugcaucaacggcacgugcaccguggugaugaccgacggguccgccagcggcaaggccgacaccaagauccucuucaucgaggagggcaagaucguccacacgucgacccuguccgggagcgcgaagcacguggaggagugcuccugcuacccccggcaccccggcgugcgcugcgucugccgggacaacuggaaggggucgaaccgcccgaucguggacaucaacaucaaggaccacuccaucgugagcuccuacgucugcucgggccuggugggcgacacgccccggaagaacgacuccagcuccucgucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggucgaaccccaaguccaagcugcagaucaaccgccaggucaucguggaccggggcaaccgcagcggguacuccggcaucuucucgguggagggcaagagcugcaucaaccggugcuucuacgucgagcucauccgcgggcggaaggaggagaccgaggugcuguggaccuccaacucgaucguggucuucugcggcaccuccgggacguacggcaccgggagcuggccggacggcgccgacaucaaccugaugcccaucuga

SEQ ID NO: 23882 - RNA, 1410 nt, Artificial Sequence
  derived and/or modified CDS sequence (AUadapt) from InfluenzaA__AEX34378__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaaccuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccaucgugagcugguccaaggagauccugcgcacccaggagucggagugcgucugcaucaacggcacgugcaccguggugaugaccgacggguccgccagcggcaaggccgacaccaagauccucuucaucgaggagggcaagaucguccacacgucgacccuguccgggagcgcgaagcacguggaggagugcuccugcuacccccggcaccccggcgugcgcugcgucugccgggacaacuggaaggggucgaaccgcccgaucguggacaucaacaucaaggaccacuccaucgugagcuccuacgucugcucgggccuggugggcgacacgccccggaagaacgacuccagcuccucgucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggucgaaccccaaguccaagcugcagaucaaccgccaggucaucguggaccggggcaaccgcagcggguacuccggcaucuucucgguggagggcaagagcugcaucaaccggugcuucuacgucgagcucauccgcgggcggaaggaggagaccgaggugcuguggaccuccaacucgaucguggucuucugcggcaccuccgggacguacggcaccgggagcuggccggacggcgccgacaucaaccugaugcccaucuga

SEQ ID NO: 23883 - RNA, 1410 nt, Artificial Sequence
  derived and/or modified CDS sequence (AUadapt) from InfluenzaA__AEX34400__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcggccggaccccguaccgcacccugcucaugaacgagcugggcgugcccuuccaccuggggacgaagcaggucugcaucgccuggagcuccucguccugccacgacggcaaggccuggcuccacgugugcaucaccggggacgacaagaacgcgaccgccagcuucaucuacaacggccggcugguggacuccguggucucgugguccaaggagauccugcgcacccaggagagcgagugcgugugcaucaacgggacgugcaccguggucaugaccgacggcuccgccucgggcaaggccgacaccaagauccucuucaucaaggaggggaagaucgugcacacgagcacccuguccggcucggcgcagcacguggaggagugcuccugcuacccccgguaccccgggguccgcugcgugugccgggacaacuggaagggcagcaaccgcccgaucguggacaucaacaucaaggaccacuccaucgucucguccuacgugugcagcggccuggugggggacacgccccggaagaacgacuccucguccagcucccacugccucgaccccaacaacgaggagggcgggcacggcgucaaggggugggccuucgacgacggcaacgacguguggaugggccgcaccaucucggagaagucccggcugggguacgagaccuucaaggucaucgagggcuggagcaaccccaaguccaagcugcagaucaaccgccaggugaucguggaccgggggaaccgcucgggcuacuccgggaucuucagcgucgagggcaagucgugcaucaaccggugcuucuacguggagcucauccgcggccggaaggaggagaccgaggugcuguggaccuccaacagcaucgucguguucugcgggaccuccggcacguacgggaccggcagcuggccggacggggccgacaucaaccugaugcccaucuga

SEQ ID NO: 23884 - RNA, 1413 nt, Artificial Sequence
  derived and/or modified CDS sequence (AUadapt) from InfluenzaA__AEX34432__NA
augaaccccaaccagaagaucaucaccaucggcucgaucuccaucgccaucgggaucaucagccugauccuccagaucggcaacaucaucuccaucugggccucgcacuccauccagaccgggagccagaaccacacgggcaucugcaaccagcgcaucaucaccuacgagaacuccaccugggugaacaacaccuacgucaacaucaacaacacgaacgugguggucgagaaggacaagaccucggugacccuggcggggaacuccagccugugcuccaucagcggcugggccaucuacaccaaggacaacuccauccggaucggcucgaagggggacguguucgucauccgcgagccguucaucuccugcagccaccucgagugccggacguucuuccugacccagggcgcccugcucaacgacaagcacuccaacgggaccgugaaggaccgcucgcccuaccgggcccugauguccugcccccugggcgaggcccccagcccguacaacucgcgcuucgaguccguggcguggagcgccuccgccugccacgacgggaugggcuggcucaccaucggcaucagcgggcccgacaacggcgccgucgcggugcugaaguacaacgggaucaucacggagaccaucaaguccuggaagaagcggauccugcgcacccaggagucggagugcgugugcaugaacggcuccugcuucaccaucaugacggacggccccagcaacgggaccgccuccuacaagaucuucaagaucgagaagggcaaggucaccaagaccaucgagcucaacgcccccaacuuccacuacgaggagugcucgugcuacccggacacggggaccgugaugugcgugugccgggacaacuggcacggcuccaaccgccccugggucagcuucaaccagaaccuggacuaccagaucggguacaucugcuccggcguguucggcgacaacccccggcccaaggacggggagggcucgugcaacccggugaccgucgacggggccgacggcgugaagggguucuccuacaaguacggcaacggcguguggaucgggcgcaccaagagcaaccggcugcgcaagggcuucgagaugaucugggaccccaacggguggacgaacaccgacuccgacuucagcgucaagcaggacgugguggccaucaccgacugguccggcuacucggggagcuucguccagcaccccgagcucaccggccuggacugcauccggcccugcuucuggguggagcugguccgcggccucccgcgggagaacacgaccaucuggaccuccgggucguccaucagcuucugcggcgugaacuccgggaccgcgaacuggagcuggcccgacggcgccgagcugcccuucacgaucgacaaguga

SEQ ID NO: 23885 - RNA, 1413 nt, Artificial Sequence; identical to SEQ ID NO: 23884
  derived and/or modified CDS sequence (AUadapt) from InfluenzaA__AEX34443__NA

SEQ ID NO: 23886 - RNA, 1410 nt, Artificial Sequence; identical to SEQ ID NO: 19005
  derived and/or modified CDS sequence (AUadapt) from InfluenzaA__AEX34454__NA

SEQ ID NO: 23887 - RNA, 1413 nt, Artificial Sequence
  derived and/or modified CDS sequence (AUadapt) from InfluenzaA__AEX34465__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcgagggguccugcaacccggugacggucgacggcgcggacgggaucaagggcuucagcuacaaguacggcaacgggguguggaucggccggaccaaguccaaccgccugcggaagggguucgagaugaucugggaccccaacggcuggaccgacaccgacagcgacuucuccgugaagcaggacgucguggccaucacggacuggucgggguacagcggcuccuucgugcagcaccccgagcucaccggccuggacugcaugcgccccugcuucugggucgagcuggugcgggggcucccgcgcgagaacaccaccaucuggacgucgggcuccagcaucuccuucugcggggucaacagcgacaccgccaacugguccuggcccgacggcgccgagcugcccuucaccaucgacaaguga

SEQ ID NO: 23888 - RNA, 1413 nt, Artificial Sequence; identical to SEQ ID NO: 23841
  derived and/or modified CDS sequence (AUadapt) from InfluenzaA__AEX34476__NA

SEQ ID NO: 23889 - RNA, 1413 nt, Artificial Sequence; identical to SEQ ID NO: 23843
  derived and/or modified CDS sequence (AUadapt) from InfluenzaA__AEX34487__NA

SEQ ID NO: 23890 - RNA, 1413 nt, Artificial Sequence; identical to SEQ ID NO: 23843
  derived and/or modified CDS sequence (AUadapt) from InfluenzaA__AEX34498__NA

SEQ ID NO: 23891 - RNA, 1413 nt, Artificial Sequence; identical to SEQ ID NO: 23843
  derived and/or modified CDS sequence (AUadapt) from InfluenzaA__AEX34509__NA

SEQ ID NO: 23892 - RNA, 1413 nt, Artificial Sequence; identical to SEQ ID NO: 23843
  derived and/or modified CDS sequence (AUadapt) from InfluenzaA__AEX34520__NA

SEQ ID NO: 23893 - RNA, 1413 nt, Artificial Sequence; identical to SEQ ID NO: 23843
  derived and/or modified CDS sequence (AUadapt) from InfluenzaA__AEX34531__NA

SEQ ID NO: 23894 - RNA, 1413 nt, Artificial Sequence; identical to SEQ ID NO: 23843
  derived and/or modified CDS sequence (AUadapt) from InfluenzaA__AEX34542__NA

SEQ ID NO: 23895 - RNA, 1413 nt, Artificial Sequence; identical to SEQ ID NO: 23843
  derived and/or modified CDS sequence (AUadapt) from InfluenzaA__AEX34553__NA

SEQ ID NO: 23896 - RNA, 1413 nt, Artificial Sequence; identical to SEQ ID NO: 23843
  derived and/or modified CDS sequence (AUadapt) from InfluenzaA__AEX34564__NA

SEQ ID NO: 23897 - RNA, 1413 nt, Artificial Sequence; identical to SEQ ID NO: 23843
  derived and/or modified CDS sequence (AUadapt) from InfluenzaA__AEX34575__NA

SEQ ID NO: 23898 - RNA, 1413 nt, Artificial Sequence; identical to SEQ ID NO: 23843
  derived and/or modified CDS sequence (AUadapt) from InfluenzaA__AEX34586__NA

SEQ ID NO: 23899 - RNA, 1413 nt, Artificial Sequence; identical to SEQ ID NO: 23843
  derived and/or modified CDS sequence (AUadapt) from InfluenzaA__AEX34597__NA

SEQ ID NO: 23900 - RNA, 1413 nt, Artificial Sequence; identical to SEQ ID NO: 23843
  derived and/or modified CDS sequence (AUadapt) from InfluenzaA__AEX34608__NA

SEQ ID NO: 23901 - RNA, 1413 nt, Artificial Sequence; identical to SEQ ID NO: 23843
  derived and/or modified CDS sequence (AUadapt) from InfluenzaA__AEX34619__NA

SEQ ID NO: 23902 - RNA, 1413 nt, Artificial Sequence; identical to SEQ ID NO: 23843
  derived and/or modified CDS sequence (AUadapt) from InfluenzaA__AEX34630__NA

SEQ ID NO: 23903 - RNA, 1413 nt, Artificial Sequence; identical to SEQ ID NO: 23843
  derived and/or modified CDS sequence (AUadapt) from InfluenzaA__AEX34641__NA

SEQ ID NO: 23904 - RNA, 1413 nt, Artificial Sequence
  derived and/or modified CDS sequence (AUadapt) from InfluenzaA__AEX34653__NA
augaaccccaaccagaagaucaucaccaucggcucgaucuccaucgccaucgggaucaucagccugaugcuccaggugggcaacaucaucuccaucugggccucgcacuccauccagaccgggagccagaaccacacgggcaucugcaaccagcgcaucaucaccuacgagaacuccaccugggucaaccacaccuacgugaacaucaacaacacgaacguggucgcggggaaggacaagaccucgguggcccuggccggcaacuccagccugugcuccaucagcggcugggccaucuacaccaaggacaacuccauccggaucgggucgaagggcgacguguucgucauccgcgagccguucaucuccugcagccaccucgagugccggaccuucuuccugacgcagggggcccugcucaacgacaagcacuccaacggcaccgugaaggaccgcucgcccuaccgggcgcugauguccugcccccugggggaggcccccagcccguacaacucgaaguucgaguccguggccuggagcgccuccgcgugccacgacggccucggcuggcugaccaucgggaucagcggccccgacaacggggccgucgccgugcugaaguacaacggcaucaucaccgagacgaucaaguccuggaagaagcgcauccuccggacccaggagucggagugcgugugcgucaacggcuccugcuucaccaucaugaccgacgggcccagcaacggcgccgccuccuacaagaucuucaagaucgagaagggccaggugaccaagucgguggagcugaacgcgcccaacuuccacuacgaggagugcuccugcuacccggacacggggaccgucaugugcgugugccgcgacaacuggcacgggagcaaccggcccuggguguccuucaaccaggaccuggacuaccagaucggcuacaucugcucgggcgucuucggggacaacccccgccccaaggacggcaagggguccugcaacccggugaccguggacggcgccgacggggucaagggcuucagcuacaaguacggcaacgggguguggaucggccggacgaaguccaaccgccuccggaagggguucgagaugaucugggaccccaacggcuggaccgacaccgacagcgacuucuccgugaagcaggacgucguggccaucaccgacuggucgggguacagcggcuccuucguccagcaccccgagcugacgggccuggacugcauccgccccugcuucuggguggagcucgugcgggggcugccgcgcgagaacaccaccaucuggaccucgggcuccagcaucuccuucugcggggucgacagcgacacggccaacugguccuggcccgacggcgccgagcugcccuucaccaucgacaaguga

SEQ ID NO: 23905 - RNA, 1413 nt, Artificial Sequence
  derived and/or modified CDS sequence (AUadapt) from InfluenzaA__AEX34664__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucucgggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggucggccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgcgcgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcucgggcguguucggggacaacccccggcccaaggacggcaagggguccugcaacccggugacggcggacggcgccgacggggucaagggcuucagcuacaaguacggcaacgggguguggaucggccgcaccaaguccaaccggcugcgcaagggguucgagaugaucugggaccccaacggcuggaccgacaccgacucggacuucuccgugaagcaggacgucguggccaucacggacuggagcggguacucgggcuccuucgugcagcaccccgagcucaccggccuggacugcauccggcccugcuucugggucgagcuggugcgcgggcucccgcgggagaacaccaccaucuggacgagcggcuccucgaucuccuucugcggggucgacagcgacaccgccaacugguccuggcccgacggcgccgagcugcccuucaccaucgacaaguga

SEQ ID NO: 23906 - RNA, 1413 nt, Artificial Sequence; identical to SEQ ID NO: 23884
  derived and/or modified CDS sequence (AUadapt) from InfluenzaA__AEX34686__NA

SEQ ID NO: 23907 - RNA, 1413 nt, Artificial Sequence
  derived and/or modified CDS sequence (AUadapt) from InfluenzaA__AEX34760__NA
augaaccccaaccagaagaucaucaccaucggcucgaucuccaucgccaucgggaucaucagccugauccuccagaucggcaacaucaucuccaucugggccucgcacuccauccagaccgggagccagaaccacacgggcaucugcaaccagcgcaucaucaccuacgagaacuccaccugggugaacaacaccuacgucaacaucaacaacacgaacgugguggucgagaaggacaagaccagcgugacccuggcggggaacuccucgcugugcuccaucagcggcugggccaucuacaccaaggacaacuccauccggaucggcucgaagggggacguguucgucauccgcgagccguucaucuccugcagccaccucgagugccggacguucuuccugacccagggcgcccugcucaacgacaagcacuccaacgggaccgugaaggaccgcagccccuaccgggcccugauguccugcccccugggcgaggcccccucgccguacaacagccgcuucgaguccguggcguggagcgccuccgccugccacgacgggaugggcuggcucaccaucggcaucucggggcccgacaacggcgccgucgcggugcugaaguacaacgggaucaucacggagaccaucaaguccuggaagaagcggauccugcgcacccaggagagcgagugcgugugcaugaacggcuccugcuucaccaucaugacggacggccccucgaacggggccgccuccuacaagaucuucaagaucgagaagggcaaggucaccaagaccaucgagcucaacgcccccaacuuccacuacgaggagugcagcugcuacccggacaccgggacggugaugugcgugugccgggacaacuggcacggcuccaaccgccccugggucagcuucaaccagaaccuggacuaccagaucggguacaucugcuccggcguguucggcgacaacccccggcccaaggacggggagggcucgugcaacccggugaccgucgacggggccgacggcgugaagggguucuccuacaaguacggcaacggcguguggaucgggcgcaccaagagcaaccggcugcgcaagggcuucgagaugaucugggaccccaacggguggaccaacacggacuccgacuucucggucaagcaggacgugguggcgaucaccgacugguccggcuacagcgggagcuucguccagcaccccgagcucaccggccuggacugcauccggcccugcuucuggguggagcugguccgcggccucccgcgggagaacaccacgaucuggaccuccgggucguccaucagcuucugcggcgugaacuccgggaccgugaacuggagcuggcccgacggcgccgagcugcccuucaccaucgacaaguga

SEQ ID NO: 23908 - RNA, 1413 nt, Artificial Sequence
  derived and/or modified CDS sequence (AUadapt) from InfluenzaA__AEX34771__NA
augaaccccaaccagaagaucaucaccaucggcucgaucuccaucgccaucgggaucaucagccugauccuccagaucggcaacaucaucuccaucugggccucgcacuccauccagaccgggagccagaaccacacgggcaucugcaaccagcgcaucaucaccuacgagaacuccaccugggugaacaacaccuacgucaacaucaacaacacgaacgugguggucgagaaggacaagaccucggugacccuggcggggaacuccagccugugcuccaucagcggcugggccaucuacaccaaggacaacuccauccggaucggcucgaagggggacguguucgucauccgcgagccguucaucuccugcagccaccucgagugccggacguucuuccugacccagggcgcccugcucaacgacaagcacuccaacgggaccgugaaggaccgcucgcccuaccgggcccugauguccugcccccugggcgaggcccccagcccguacaacucgcgcuucgaguccguggcguggagcgccuccgccugccacgacgggaugggcuggcucaccaucggcaucagcgggcccgacaacggcgccgucgcggugcugaaguacaacgggaucaucacggagaccaucaaguccuggaagaagcggauccugcgcacccaggagucggagugcgugugcaugaacggcuccugcuucaccaucaugacggacggccccagcaacggggccgccuccuacaagaucuucaagaucgagaagggcaaggucaccaagaccaucgagcucaacgcccccaacuuccacuacgaggagugcucgugcuacccggacaccgggacggugaugugcgugugccgggacaacuggcacggcuccaaccgccccugggucagcuucaaccagaaccuggacuaccagaucggguacaucugcuccggcguguucggcgacaacccccggcccaaggacggggagggcucgugcaacccggugaccgucgacggggccgacggcgugaagggguucuccuacaaguacggcaacggcguguggaucgggcgcaccaagagcaaccggcugcgcaagggcuucgagaugaucugggaccccaacggguggaccaacacggacuccgacuucagcgucaagcaggacgugguggcgaucaccgacugguccggcuacucggggagcuucguccagcaccccgagcucaccggccuggacugcauccggcccugcuucuggguggagcugguccgcggccucccgcgggagaacaccacgaucuggaccuccgggucguccaucagcuucugcggcgugaacuccgggaccgccaacuggagcuggcccgacggcgccgagcugcccuucaccaucgacaaguga

SEQ ID NO: 23909 - RNA, 1413 nt, Artificial Sequence; identical to SEQ ID NO: 19863
  derived and/or modified CDS sequence (AUadapt) from InfluenzaA__AEX34782__NA

SEQ ID NO: 23910 - RNA, 1413 nt, Artificial Sequence
  derived and/or modified CDS sequence (AUadapt) from InfluenzaA__AEX34793__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccccggucacccuggugggcaacagcucccugugcucgaucuccggcugggccaucuacaccaaggacaacagcauccggaucggguccaagggcgacguguucgucauccgcgagcccuucaucucgugcucccaccucgagugcaagacguucuuccugacccagggggcccugcucaacgacaagcacagcaacggcaccgugaaggaccggucccccuaccgcgcccugaugagcugcccccugggggaggccccgucccccuacaacucgaaguucgagagcguggcgugguccgccucggccugccacgacggcaucggcuggcucaccaucgggaucuccggccccgacaacggggccgucgcggugcugaaguacaagggcaucaucacgggcaccaucaagagcuggaagaagcagauccugcggacccaggaguccgagugcgugugcaugaacgggagcugcuucaccaucaugacggacggccccuccaacggggccgccucguacaagaucuucaagaucgagaagggcaaggucaccaaguccauggagcucaacgccccgaacuuccacuacgaggagugcagcugcuaccccgacaccgggaccgugaugugcgugugccgcgacaacuggcacggcuccaaccggcccugggucucguucaaccagaaccuggacuaccagaucggcuacaucugcuccgggguguucggcgacaacccccgcccgaaggaccgggaggggagcugcaaccccgugacggucgacggcgccaacggggugaagggcuucuccuacaaguacggcaacgggguguggaucggccgcaccaagagcaaccggauccgcaagggguucgagaugaucugggaccccaacggcuggaccaacaccgacuccgacuucucggucaagcaggacaucguggcgaucacggacugguccggguacagcggcucguucgugcagcaccccgagcugaccggccucgacugcauccggccgugcuucugggucgagcuggugcgcgggcugccccgggagaacaccaccaucuggacguccggcagcuccaucagcuucugcggggucaacggcgacaucgccaacugguccuggcccgacggcgccgagcuccccuucaccaucgacaaguga

SEQ ID NO: 23911 - RNA, 1413 nt, Artificial Sequence; identical to SEQ ID NO: 23910
  derived and/or modified CDS sequence (AUadapt) from InfluenzaA__AEX34804__NA

SEQ ID NO: 23912 - RNA, 1413 nt, Artificial Sequence
  derived and/or modified CDS sequence (AUadapt) from InfluenzaA__AEX34815__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccugaccggcaacuccucgcugugcuccaucagcggcugggccaucuacacgaaggacaacuccauccggaucgggagcaagggcgacguguucgugauccgcgagccguucaucuccugcucgcaccucgagugccggaccuucuuccugacccagggggcccugcucaacgacaagcacuccaacggcaccgucaaggaccgcagccccuaccgggcccugauguccugcccccugggggaggcccccagcccguacaacucgaaguucgaguccguggcguggagcgccuccgccugccacgacggcaugggcuggcucacgaucgggaucagcggccccgacaacggggccguggcgguccugaaguacaacggcaucaucaccggcaccaucaaguccuggaagaagcagauccugcgcacccaggagucggagugcgugugcaugaacggguccugcuucacgaucaugaccgacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggucgaaccgccccuggguguccuucaaccagaaccuggacuaccagaucggcuacaucugcagcggcgucuucggggacaacccccggcccgaggacggcgagggguccugcaacccggugacgguggacggcgccaacggggucaagggcuucagcuacaaguacggcaacgggguguggaucggccgcaccaaguccaaccggcugcgcaagggguucgagaugaucugggaccccaacggcuggaccaacaccgacucggacuucuccgugaagcaggacgucguggcgaucacggacuggagcggguacagcggcuccuucgugcagcaccccgagcucaccggccuggacugcauccggcccugcuucugggucgagcuggugcgcgggcucccgcgggagaacaccaccaucuggacgucgggcuccagcaucuccuucugcggggucaacagcgacaccgccaacugguccuggcccgacggcgccgagcugcccuucaccaucgacaaguga

SEQ ID NO: 23913 - RNA, 1413 nt, Artificial Sequence; identical to SEQ ID NO: 23910
  derived and/or modified CDS sequence (AUadapt) from InfluenzaA__AEX34826__NA

SEQ ID NO: 23914 - RNA, 1413 nt, Artificial Sequence; identical to SEQ ID NO: 23910
  derived and/or modified CDS sequence (AUadapt) from InfluenzaA__AEX34837__NA

SEQ ID NO: 23915 - RNA, 1413 nt, Artificial Sequence
  derived and/or modified CDS sequence (AUadapt) from InfluenzaA__AEX34859__NA
augaaccccaaccagaagaucaucaccaucggcucgaccuccaucgccaucgggaucaucagccugaugcuccagaucggcaacaucaucuccaucugggccucgcacuccauccagacggggagccagaaccacaccggcaucugcaaccagcgcaucaucaccuacgagaacuccaccugggugaaccacacguacgucaacaucaacaacaccaacgugguggcggggaaggacaagaccccggucacccugaucggcaacucgucccugugcagcaucuccggcugggccaucuacacgaaggacaacucgauccggaucggguccaagggcgacguguucgugauccgcgagcccuucaucagcugcucccaccucgagugcaagaccuucuuccugacccagggggcccugcucaacgacaagcacagcaacggcaccgucaaggaccggucccccuaccgcgcccugaugucgugcccccugggggaggccccgucccccuacaacagcaaguucgagucgguggcgugguccgccagcgccugccacgacggcaucggcuggcucacgaucgggaucuccggccccgacaacggggccguggcgguccugaaguacaagggcaucaucaccggcaccaucaagucguggaagaagcagauccugcggacccaggaguccgagugcgugugcaugaacgggagcugcuucacgaucaugaccgacggccccuccaacggggccgccucguacaagaucuucaagaucgagaagggcaaggugaccaaguccauggagcucaacgccccgaacuuccacuacgaggagugcagcugcuaccccgacaccgggacggucaugugcgugugccgcgacaacuggcacggcuccaaccggcccugggugagcuucaaccagaaccuggacuaccagaucggcuacaucugcuccggggucuucggcgacaacccccgcccgaaggaccgggaggggucgugcaaccccgugaccguggacggcgccaacggggucaagggcuucuccuacaaguacggcaacgggguguggaucggccgcaccaagagcaaccggauccgcaagggguucgagaugaucugggaccccaacggcuggaccaacacggacuccgacuucucggugaagcaggacaucgucgcgaucaccgacugguccggguacagcggcucguucgugcagcaccccgagcugaccggccucgacugcauccggccgugcuucuggguggagcugguccgcgggcugccccgggagaacaccacgaucuggaccuccggcagcuccaucagcuucugcggggugaacggcgacaucgccaacugguccuggcccgacggcgccgagcuccccuucaccaucgacaaguga

SEQ ID NO: 23916 - RNA, 1413 nt, Artificial Sequence
  derived and/or modified CDS sequence (AUadapt) from InfluenzaA__AEX34870__NA
augaaccccaaccagaagaucaucaccaucggcucgaucuccaucgccaucgggaucaucagccugaugcuccagaucggcaacaucaucuccaucugggccagccacuccauccagaccgggucgcagaacaacacgggcaucugcaaccagcgcaucaucaccuacgagaacuccaccugggugaaccacaccuacgucaacaucaacaacacgaacgugguggcgggggaggacaagaucagcgucacccuggccggcaacuccagccugugcuccaucucgggcugggccaucuacaccaaggacaacuccauccggaucgggagcaagggcgacguguucgugauccgcgagccguucaucuccugcagccaccucgagugccggaccuucuuccugacgcagggggcccugcucaacgacaagcacuccaacggcaccgucaaggaccgcucgcccuaccgggcccugauguccugcccccugggggaggcgcccagcccguacaacagcaaguucgaguccguggccuggagcgccuccgccugccacgacggcaucggcuggcucaccaucgggaucucgggccccgacaacggggcgguggccguccugaaguacaacggcaucaucaccggcacgaucaaguccuggaagaagcagauccugcgcacccaggagagcgagugcgugugcaugaacggguccugcuucaccaucaugaccgacggccccagcaacaaggccgccuccuacaagaucuucaagaucgagaaggggaaggugaccaagucgaucgagcucaacgcccccaacuucuacuacgaggagugcuccugcuacccggacacgggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucucguacaaguacggcaacgggguguggaucggccgcaccaaguccaaccggcugcgcaagggguucgagaugaucugggaccccaacggcuggacgaacaccgacagcgacuucuccgugaagcaggacgucguggccaucaccgacuggagcggguacucgggcuccuucgugcagcaccccgagcucaccggccuggacugcauccggcccugcuucugggucgagcuggugcgcgggcucccgcgggagaacacgaccaucuggaccagcggcuccagcaucuccuucugcggggucaacagcgacaccgccaacugguccuggcccgacggcgccgagcugcccuucacgaucgacaaguga

SEQ ID NO: 23917 - RNA, 1413 nt, Artificial Sequence
  derived and/or modified CDS sequence (AUadapt) from InfluenzaA__AEX34881__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaaggccccggucacccugaucggcaacagcucccugugcucgaucuccggcugggccaucuacaccaaggacaacagcauccggaucggguccaagggcgacguguucgugauccgcgagcccuucaucucgugcucccaccucgagugcaagaccuucuuccugacgcagggggcccugcucaacgacaagcacagcaacggcaccgucaaggaccggucccccuaccgcgcccugaugagcugcccccugggggaggcgccgucccccuacaacucgaaguucgagagcguggccugguccgccucggccugccacgacggcaucggcuggcucaccaucgggaucuccggccccgacaacggggcgguggccguccugaaguacaagggcaucaucaccggcacgaucaagagcuggaagaagcagauccugcggacccaggaguccgagugcgugugcaugaacgggagcugcuucaccaucaugaccgacggccccuccaacggggccgccucguacaagaucuucaagaucgagaagggcaaggugacgaaguccauggagcucaacgccccgaacuuccacuacgaggagugcagcugcuaccccgacaccgggaccgucaugugcgugugccgcgacaacuggcacggcuccaaccggcccugggugucguucaaccagaaccuggacuaccagaucggcuacaucugcuccggggucuucggcgacaacccccgcccgaaggaccgggaggggagcugcaaccccgugaccguggacggcgcgaacggggucaagggcuucuccuacaaguacggcaacgggguguggaucggccgcaccaagagcaaccggauccgcaagggguucgagaugaucugggaccccaacggcuggacgaacaccgacuccgacuucucggugaagcaggacaucgucgccaucaccgacugguccggguacagcggcucguucgugcagcaccccgagcugacgggccucgacugcauccggccgugcuucuggguggagcugguccgcgggcugccccgggagaacaccaccaucuggaccuccggcagcuccaucagcuucugcggggugaacggcgacaucgccaacugguccuggcccgacggcgccgagcuccccuucacgaucgacaaguga

SEQ ID NO: 23918 - RNA, 1413 nt, Artificial Sequence
  derived and/or modified CDS sequence (AUadapt) from InfluenzaA__AEX34892__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggucgaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacucggacuucuccgugaagcagaacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccucgggcuccagcaucuccuucugcggggucaacagcgacacggccaacugguccuggcccgacggcgccgagcugcccuucaccaucgacaaguga

SEQ ID NO: 23919 - RNA, 1413 nt, Artificial Sequence
  derived and/or modified CDS sequence (AUadapt) from InfluenzaA__AEX34903__NA
augaaccccaaccagaagaucaucaccaucggcucgaucuccaucgccaucgggaucaucagccugaugcuccagaucggcaacaucaucuccaucugggccucgcgcuccauccagaccgggagccagaaccacacgggcaucugcaaccagcggaucaucaccuacgagaacuccaccugggugaaccacaccuacgucaacaucaacaacacgaacgugguggcggggaaggacaagaccccggucacccuggugggcaacagcucccugugcucgaucuccggcugggccaucuacaccaaggacaacagcauccgcaucggguccaagggcgacguguucgucauccgggagcccuucaucucgugcucccaccucgagugcaagacguucuuccugacccagggggcccugcucaacgacaagcacagcaacggcaccgugaaggaccgcucccccuaccgggcccugaugagcugcccccugggggaggccccgucccccuacaacucgaaguucgagagcguggcgugguccgccucggccugccacgacggcaucggcuggcucaccaucgggaucuccggccccgacaacggggccgucgcggugcugaaguacaagggcaucaucacgggcaccaucaagagcuggaagaagcagauccugcgcacccaggaguccgagugcgugugcaugaacgggagcugcuucaccaucaugacggacggccccuccaacggggccgccucguacaagaucuucaagaucgagaagggcaaggucaccaaguccauggagcucaacgccccgaacuuccacuacgaggagugcagcugcuaccccgacaccgggaccgugaugugcgugugccgggacaacuggcacggcuccaaccgccccugggucucguucaaccagaaccuggacuaccagaucggcuacaucugcuccgggguguucggcgacaacccccggccgaaggaccgcgaggggagcugcaaccccgugacggucgacggcgccaacggggugaagggcuucuccuacaaguacggcaacgggguguggaucggccggaccaagagcaaccgcauccggaagggguucgagaugaucugggaccccaacggcuggaccaacaccgacuccgacuucucgguccgccaggacaucguggcgaucacggacugguccggguacagcggcucguucgugcagcaccccgagcugaccggccucgacugcauccggccgugcuucugggucgagcuggugcgcgggcugccccgggagaacaccaccaucuggacguccggcagcuccaucagcuucugcggggucaacggcgacaucgccaacugguccuggcccgacggcgccgagcuccccuucaccaucgacaaguga

SEQ ID NO: 23920 - RNA, 1413 nt, Artificial Sequence; identical to SEQ ID NO: 19863
  derived and/or modified CDS sequence (AUadapt) from InfluenzaA__AEX34914__NA

SEQ ID NO: 23921 - RNA, 1413 nt, Artificial Sequence; identical to SEQ ID NO: 19863
  derived and/or modified CDS sequence (AUadapt) from InfluenzaA__AEX34925__NA

SEQ ID NO: 23922 - RNA, 1413 nt, Artificial Sequence; identical to SEQ ID NO: 19863
  derived and/or modified CDS sequence (AUadapt) from InfluenzaA__AEX34936__NA

SEQ ID NO: 23923 - RNA, 1413 nt, Artificial Sequence; identical to SEQ ID NO: 19863
  derived and/or modified CDS sequence (AUadapt) from InfluenzaA__AEX34947__NA

SEQ ID NO: 23924 - RNA, 1413 nt, Artificial Sequence; identical to SEQ ID NO: 19863
  derived and/or modified CDS sequence (AUadapt) from InfluenzaA__AEX34958__NA

SEQ ID NO: 23925 - RNA, 1413 nt, Artificial Sequence; identical to SEQ ID NO: 19863
  derived and/or modified CDS sequence (AUadapt) from InfluenzaA__AEX34969__NA

SEQ ID NO: 23926 - RNA, 1413 nt, Artificial Sequence; identical to SEQ ID NO: 19863
  derived and/or modified CDS sequence (AUadapt) from InfluenzaA__AEX34980__NA

SEQ ID NO: 23927 - RNA, 1413 nt, Artificial Sequence; identical to SEQ ID NO: 19863
  derived and/or modified CDS sequence (AUadapt) from InfluenzaA__AEX34991__NA

SEQ ID NO: 23928 - RNA, 1413 nt, Artificial Sequence
  derived and/or modified CDS sequence (AUadapt) from InfluenzaA__AEX35002__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccccggucacccugaucggcaacagcucccugugcucgaucuccggcugggccaucuacaccaaggacaacagcauccggaucggguccaagggcgacguguucgugauccgcgagcccuucaucucgugcucccaccucgagugcaagacguucuuccugacccagggggcccugcucaacgacaagcacagcaacggcaccgucaaggaccggucccccuaccgcgcccugaugagcugcccccugggggaggccccgucccccuacaacucgaaguucgagagcguggcgugguccgccucggccugccacgacggcaucggcuggcucaccaucgggaucuccggccccgacaacggggccguggcgguccugaaguacaagggcaucaucacgggcaccaucaagagcuggaagaagcagauccugcggacccaggaguccgagugcgugugcaugaacgggagcugcuucaccaucaugacggacggccccuccaacggggccgccucguacaagaucuucaagaucgagaagggcaaggugaccaaguccauggagcucaacgccccgaacuuccacuacgaggagugcagcugcuaccccgacaccgggaccgucaugugcgugugccgcgacaacuggcacggcuccaaccggcccugggugucguucaaccagaaccuggacuaccagaucggcuacaucugcuccggggucuucggcgacaacccccgcccgaaggaccgggaggggagcugcaaccccgugacgguggacggcgccaacggggucaagggcuucuccuacaaguacggcaacgggguguggaucggccgcaccaagagcaaccggauccgcaagggguucgagaugaucugggaccccaacggcuggaccaacaccgacuccgacuucucggugaagcaggacaucgucgcgaucacggacugguccggguacagcggcucguucgugcagcaccccgagcugaccggccucgacugcauccggccgugcuucuggguggagcugguccgcgggcugccccgggagaacaccaccaucuggacguccggcagcuccaucagcuucugcggggugaacggcgacaucgccaacugguccuggcccgacggcgccgagcuccccuucaccaucgacaaguga

SEQ ID NO: 23929 - RNA, 1413 nt, Artificial Sequence; identical to SEQ ID NO: 19863
  derived and/or modified CDS sequence (AUadapt) from InfluenzaA__AEX35013__NA

SEQ ID NO: 23930 - RNA, 1413 nt, Artificial Sequence; identical to SEQ ID NO: 19863
  derived and/or modified CDS sequence (AUadapt) from InfluenzaA__AEX35024__NA

SEQ ID NO: 23931 - RNA, 1413 nt, Artificial Sequence; identical to SEQ ID NO: 19863
  derived and/or modified CDS sequence (AUadapt) from InfluenzaA__AEX35035__NA

SEQ ID NO: 23932 - RNA, 1413 nt, Artificial Sequence; identical to SEQ ID NO: 19863
  derived and/or modified CDS sequence (AUadapt) from InfluenzaA__AEX35046__NA

SEQ ID NO: 23933 - RNA, 1413 nt, Artificial Sequence; identical to SEQ ID NO: 19863
  derived and/or modified CDS sequence (AUadapt) from InfluenzaA__AEX35057__NA

SEQ ID NO: 23934 - RNA, 1413 nt, Artificial Sequence; identical to SEQ ID NO: 19863
  derived and/or modified CDS sequence (AUadapt) from InfluenzaA__AEX35068__NA

SEQ ID NO: 23935 - RNA, 1413 nt, Artificial Sequence
  derived and/or modified CDS sequence (AUadapt) from InfluenzaA__AEX35079__NA
augaaccccaaccagaagaucaucaccaucggcucgaucuccaucgccaucgggaucaucagccugaugcuccagaucggcaacaucaucuccaugugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggucgaaccgccccuggguguccuucaaccaggaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacucggacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccucgggcuccagcaucuccuucugcggggucaacagcgacacggccaacugguccuggcccgacggcgccgagcugcccuucaccaucgacaaguga

SEQ ID NO: 23936 - RNA, 1413 nt, Artificial Sequence; identical to SEQ ID NO: 23910
  derived and/or modified CDS sequence (AUadapt) from InfluenzaA__AEX35090__NA

SEQ ID NO: 23937 - RNA, 1413 nt, Artificial Sequence
  derived and/or modified CDS sequence (AUadapt) from InfluenzaA__AEX35101__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggucgaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacgacaacggcguguggaucgggcgcacgaaguccaaccggcugcgcaagggcuucgagaugaucugggaccccaacggguggaccaacaccgacucgguguucuccgucaagcaggacgugguggccaucaccgacuggagcggcuacagcggguccuucguccagcaccccgagcucacgggccuggacugcauccggcccugcuucuggguggagcugguccgcggccucccgcgggagaacaccaccaucuggaccucgggguccagcaucuccuucugcggcgugaacagcgacacggccaacugguccuggcccgacggggccgagcugcccuucaccaucgacaaguga

SEQ ID NO: 23938 - RNA, 1413 nt, Artificial Sequence
  derived and/or modified CDS sequence (AUadapt) from InfluenzaA__AEX35112__NA
augaaccccaaccagaagaucaucaccaucggcucgaucuccaucgccaucgggaucaucagccugaugcuccagaucggcaacaucaucuccaucugggccagccacuccauccagaccgggucgcagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucucgggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacagcaaguucgaguccguggccuggucggccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacaaggccgccuccuacaagaucuucaagaucgagaaggggaaggugaccaagagcaucgagcucaacgccuccaacuucuacuacgaggagugcagcugcuaccccgacaccggcaucgucaugugcgugugccgggacaacuggcacggguccaaccgcccgugggugucguucaaccagaaccuggacuaccagaucggcuacaucugcuccggcgucuucggggacaacccccggcccgaggacggcgaggggagcugcaaccccgugaccguggacggcgcgaacggggucaagggcuucuccuacaaguacggcaacgggguguggaucggccgcaccaagagcaaccggcugcgcaagggguucgagaugaucugggacccgaacggcuggacgaacaccgacuccgacuucucggugaagcaggacgucguggccaucaccgacuggagcggguacuccggcagcuucgugcagcaccccgagcucacgggccuggacugcauccggcccugcuucugggucgagcuggugcgcgggcucccccgggagaacaccaccaucuggaccuccggcucguccaucagcuucugcggggucaacuccgacacggccaacuggagcuggccggacggcgccgagcugcccuucaccaucgacaaguga

SEQ ID NO: 23939 - RNA, 1413 nt, Artificial Sequence; identical to SEQ ID NO: 19863
  derived and/or modified CDS sequence (AUadapt) from InfluenzaA__AEX35123__NA

SEQ ID NO: 23940 - RNA, 1413 nt, Artificial Sequence
  derived and/or modified CDS sequence (AUadapt) from InfluenzaA__AEX35145__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggucgaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacucggacuucuccgugaagcaggacaucgucgccaucaccgacuggagcggguacagcggcuccuucgugcagcaccccgagcucacgggccuggacugcauccggcccugcuucuggguggagcugguccgcgggcucccgcgggagaacaccaccaucuggaccucgggcuccagcaucuccuucugcggggugaacagcgacacggccaacugguccuggcccgacggcgccgagcugcccuucaccaucgacaaguga

SEQ ID NO: 23941 - RNA, 1413 nt, Artificial Sequence; identical to SEQ ID NO: 23910
  derived and/or modified CDS sequence (AUadapt) from InfluenzaA__AEX35156__NA

SEQ ID NO: 23942 - RNA, 1413 nt, Artificial Sequence; identical to SEQ ID NO: 19863
  derived and/or modified CDS sequence (AUadapt) from InfluenzaA__AEX35167__NA

SEQ ID NO: 23943 - RNA, 1413 nt, Artificial Sequence
  derived and/or modified CDS sequence (AUadapt) from InfluenzaA__AEX35178__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucucgggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggucggccuccgccugccacgacggcaugggcuggcucaccaucgggaucagcggccccgacaacggggcgguggccguccugaaguacaacggcaucaucacggagaccaucaaguccuggaaggagcgcauccugcggacccaggagucggagugcgugugcgugaacggcuccugcuucaccaucaugacggacgggcccagcaacggcgccgccuccuacaagaucuucaagaucgagaaggggaaggucaccaagucgcgcgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcucgggcguguucggggacaacccccggcccaaggacggcaagggguccugcaacccggugacggcggacggcgccgacggggucaagggcuucagcuacaaguacggcaacgggguguggaucggccgcaccaaguccaaccggcugcgcaagggguucgagaugaucugggaccccaacggcuggaccgacaccgacucggacuucuccgugaagcaggacgucguggccaucacggacuggagcggguacucgggcuccuucgugcagcaccccgagcucaccggccuggacugcauccggcccugcuucugggucgagcuggugcgcgggcucccgcgggagaacaccaccaucuggacgagcggcuccucgaucuccuucugcggggucgacagcgacaccgccaacugguccuggcccgacggcgccgagcugcccuucaccaucgacaaguga

SEQ ID NO: 23944 - RNA, 1413 nt, Artificial Sequence; identical to SEQ ID NO: 23884
  derived and/or modified CDS sequence (AUadapt) from InfluenzaA__AEX35189__NA

SEQ ID NO: 23945 - RNA, 1413 nt, Artificial Sequence; identical to SEQ ID NO: 23884
  derived and/or modified CDS sequence (AUadapt) from InfluenzaA__AEX35200__NA

SEQ ID NO: 23946 - RNA, 1413 nt, Artificial Sequence; identical to SEQ ID NO: 19863
  derived and/or modified CDS sequence (AUadapt) from InfluenzaA__AEX35211__NA

SEQ ID NO: 23947 - RNA, 1410 nt, Artificial Sequence
  derived and/or modified CDS sequence (AUadapt) from InfluenzaA__AEX35222__NA
augaaccccaaccagaagaucaucaccaucggcucggugucccugaccaucucgacgaucugcuucuucaugcagaucgccauccucgucaccaccgugacccugcacuucaagcaguacgagugcaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggagcaagccgcagugcaacaucaccggguucgcgcccuucuccaaggacaacucgauccgccuguccgccggcggggacaucugggugacccgggagcccuacgugagcugcgaccccgacaagugcuaccaguucgcccucggccaggggaccacgcugaacaacggccacuccaacgacaccguccacgaccgcaccccguaccggacccugcucaugaacgagcugggcgugcccuuccaccuggggacgaagcaggucugcaucgccuggucguccagcuccugccacgacggcaaggccuggcuccacgugugcgugaccggggacgacgagaacgcgaccgccucguucaucuacaacggccgccugguggacuccaucgggucgugguccaagaagauccugcggacccaggagagcgagugcgucugcaucaacggcacgugcaccguggugaugaccgacggcuccgccucggggaaggccgacaccaagauccucuucaucgaggagggcaagaucguccacacgagcacccuguccgggucggcgcagcacguggaggagugcuccugcuacccccgcuaccccggcgugcggugcgucugccgcgacaacuggaagggcagcaaccggccgaucguggacaucaacaucaaggacuacuccaucgugucguccuacgucugcagcgggcuggugggcgacacgccccgcaagaacgacuccucguccucgucccacugccucgaccccaacaacgaggagggcgggcacggggugaagggcugggccuucgacgacggcaacgacgucuggauggggcggaccaucagcgagaagcugcgcuccggcuacgagaccuucaaggugaucgagggguggucgaagcccaacuccaagcugcagaucaaccggcaggucaucguggaccgcggcaaccggagcggguacuccggcaucuucucgguggagggcaagagcugcaucaaccgcugcuucuacgucgagcucauccgggggcgcaagcaggagaccgaggugcuguggaccuccaacucgaucguggucuucugcggcaccuccgggacguacggcaccgggagcuggccggacggcgccgacaucaaccugaugcccaucuga

SEQ ID NO: 23948 - RNA, 1413 nt, Artificial Sequence; identical to SEQ ID NO: 23843
  derived and/or modified CDS sequence (AUadapt) from InfluenzaA__AEX35233__NA

SEQ ID NO: 23949 - RNA, 1410 nt, Artificial Sequence
  derived and/or modified CDS sequence (AUadapt) from InfluenzaA__AEX35244__NA
augaaccccaaccagaagaucaucaccaucggcucggugucccugaccaucagcacgaucugcuucuucaugcagaucgccauccucaucaacaccgucacccugcacuucaagcaguacgaguucaacuccccgcccaacaaccaggugaugcugugcgagcccaccaucaucgagcgcaacaucacggagaucguguaccucaccaacaccaccaucgagaaggagaucugccccaagcuggccgaguaccggaacuggucgaagccgcagugcaacaucacgggguucgcgcccuucuccaaggacaacagcauccgccuguccgccggcggggacaucugggucacccgggagcccuacgugucgugcgaccccgacaagugcuaccaguucgcccucggccaggggaccacccugaacaacgugcacuccaacgacacgguccacgaccgcaccccguaccggacccugcucaugaacgagcugggcgugcccuuccaccugggcaccaagcaggucugcaucgccuggagcuccucguccugccacgacgggaaggccuggcuccacgugugcgugacgggcgacgacaagaacgcgaccgccagcuucaucuacaacgggcgccugguggacuccaucgucagcugguccaagaagauccugcggacccaggagucggagugcgugugcaucaacgggaccugcacgguggucaugaccgacggguccgccagcggcaaggccgacaccaagauccucuucaucgaggagggcaagaucgugcacaccucgacgcuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcggcaacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaagcaggagaacgaggugcuguggaccuccaacagcaucgucguguucugcggcaccuccgggaccuacggcaccgggagcuggccggacggcgccgacaucaaccugaugcccguguga

SEQ ID NO: 23950 - RNA, 1410 nt, Artificial Sequence; identical to SEQ ID NO: 18331
  derived and/or modified CDS sequence (AUadapt) from InfluenzaA__AEX35255__NA

SEQ ID NO: 23951 - RNA, 1413 nt, Artificial Sequence; identical to SEQ ID NO: 23843
  derived and/or modified CDS sequence (AUadapt) from InfluenzaA__AEX35266__NA

SEQ ID NO: 23952 - RNA, 1413 nt, Artificial Sequence; identical to SEQ ID NO: 23843
  derived and/or modified CDS sequence (AUadapt) from InfluenzaA__AEX35277__NA

SEQ ID NO: 23953 - RNA, 1410 nt, Artificial Sequence
  derived and/or modified CDS sequence (AUadapt) from InfluenzaA__AEX35288__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacaaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 23954 - RNA, 1410 nt, Artificial Sequence; identical to SEQ ID NO: 17116
  derived and/or modified CDS sequence (AUadapt) from InfluenzaA__AEX35299__NA

SEQ ID NO: 23955 - RNA, 1410 nt, Artificial Sequence
  derived and/or modified CDS sequence (AUadapt) from InfluenzaA__AEX35310__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacgagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacggggacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaccaggagaccgaggugcuguggaccuccaacagcaucgucguguucugcggcaccuccgggacguacggcaccgggagcuggccggacggcgccgacaucaaccugaugcccaucuga

SEQ ID NO: 23956 - RNA, 1410 nt, Artificial Sequence; identical to SEQ ID NO: 17116
  derived and/or modified CDS sequence (AUadapt) from InfluenzaA__AEX35321__NA

SEQ ID NO: 23957 - RNA, 1410 nt, Artificial Sequence; identical to SEQ ID NO: 18331
  derived and/or modified CDS sequence (AUadapt) from InfluenzaA__AEX35332__NA

SEQ ID NO: 23958 - RNA, 1410 nt, Artificial Sequence; identical to SEQ ID NO: 18331
  derived and/or modified CDS sequence (AUadapt) from InfluenzaA__AEX35343__NA

SEQ ID NO: 23959 - RNA, 1410 nt, Artificial Sequence
  derived and/or modified CDS sequence (AUadapt) from InfluenzaA__AEX35354__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaagaagauccugcggacccaggagucggagugcgugugcaucaacggcacgugcaccguggucaugaccgacggguccaccagcggcaaggccgacacgaagauccucuucaucgaggagggcaagaucgugcacaccucgacccuguccgggagcgcccagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggcguucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcacguccgggaccuacggcaccgggagcuggccggacggcgccgacaucaaccugaugcccaucuga

SEQ ID NO: 23960 - RNA, 1410 nt, Artificial Sequence; identical to SEQ ID NO: 17116
  derived and/or modified CDS sequence (AUadapt) from InfluenzaA__AEX35365__NA

SEQ ID NO: 23961 - RNA, 1410 nt, Artificial Sequence
  derived and/or modified CDS sequence (AUadapt) from InfluenzaA__AEX35376__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgagcgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 23962 - RNA, 1410 nt, Artificial Sequence; identical to SEQ ID NO: 17116
  derived and/or modified CDS sequence (AUadapt) from InfluenzaA__AEX35387__NA

SEQ ID NO: 23963 - RNA, 1410 nt, Artificial Sequence
  derived and/or modified CDS sequence (AUadapt) from InfluenzaA__AEX35398__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaagaagauccugcggacccaggagucggagugcgugugcaucaacggcacgugcgccguggucaugaccgacggguccgccagcggcaaggcggacaccaagauccucuucaucgaggagggcaagaucgugcacaccucgacgcuguccgggagcgcccagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggaccuacggcacggggagcuggccggacggcgccgacaucaaccugaugcccaucuga

SEQ ID NO: 23964 - RNA, 1410 nt, Artificial Sequence; identical to SEQ ID NO: 17116
  derived and/or modified CDS sequence (AUadapt) from InfluenzaA__AEX35409__NA

SEQ ID NO: 23965 - RNA, 1410 nt, Artificial Sequence; identical to SEQ ID NO: 23953
  derived and/or modified CDS sequence (AUadapt) from InfluenzaA__AEX35420__NA

SEQ ID NO: 23966 - RNA, 1410 nt, Artificial Sequence
  derived and/or modified CDS sequence (AUadapt) from InfluenzaA__AEX35431__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacgagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaagaaggagaccgaggugcuguggaccuccaacagcaucgucguguucugcggcaccuccgggacguacggcaccgggagcuggccggacggcgccgacaucaaccugaugcccaucuga

SEQ ID NO: 23967 - RNA, 1410 nt, Artificial Sequence; identical to SEQ ID NO: 17114
  derived and/or modified CDS sequence (AUadapt) from InfluenzaA__AEX35453__NA

SEQ ID NO: 23968 - RNA, 1410 nt, Artificial Sequence; identical to SEQ ID NO: 17114
  derived and/or modified CDS sequence (AUadapt) from InfluenzaA__AEX35464__NA

SEQ ID NO: 23969 - RNA, 1410 nt, Artificial Sequence; identical to SEQ ID NO: 17114
  derived and/or modified CDS sequence (AUadapt) from InfluenzaA__AEX35475__NA

SEQ ID NO: 23970 - RNA, 1410 nt, Artificial Sequence; identical to SEQ ID NO: 17114
  derived and/or modified CDS sequence (AUadapt) from InfluenzaA__AEX35486__NA

SEQ ID NO: 23971 - RNA, 1410 nt, Artificial Sequence
  derived and/or modified CDS sequence (AUadapt) from InfluenzaA__AEX35497__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaagugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 23972 - RNA, 1410 nt, Artificial Sequence; identical to SEQ ID NO: 17114
  derived and/or modified CDS sequence (AUadapt) from InfluenzaA__AEX35508__NA

SEQ ID NO: 23973 - RNA, 1410 nt, Artificial Sequence; identical to SEQ ID NO: 23971
  derived and/or modified CDS sequence (AUadapt) from InfluenzaA__AEX35519__NA

SEQ ID NO: 23974 - RNA, 1410 nt, Artificial Sequence
  derived and/or modified CDS sequence (AUadapt) from InfluenzaA__AEX35530__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcagugcgagcccacgaucaucgagcgcaacaucaccgagaucguguaccugaccaacaccacgaucgagaaggagaucugccccaagcucgccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccugggccaggggaccacgcucaacaacgugcacuccaacgacaccguccacgaccgcaccccguaccggacccugcugaugaacgagcucggcgugcccuuccaccugggcacgaagcaggucugcaucgccuggagcuccucguccugccacgacgggaaggccuggcugcacgugugcgugaccggcgacgacaagaacgcgaccgccagcuucaucuacaacgggcgccucguggacuccaucgucucgugguccaaggagauccugcggacccaggagagcgagugcgugugcaucaacggcacgugcaccguggucaugaccgacggguccgccucgggcaaggccgacaccaagauccuguucaucgaggagggcaagaucgugcacacgagcacccucuccgggucggcgcagcacguggaggagugcuccugcuacccccgcuaccccggcguccggugcgugugccgcgacaacuggaaggggagcaaccggccgaucguggacaucaacaccaaggacuacuccaucgucucguccuacgugugcagcggccuggugggcgacacgccccgcaagaacgacuccucguccagcucccacugccugaaccccaacaacgaggagggcgggcacggggucaagggcugggccuucgacgacgggaacgacguguggaugggccggaccaucucggagaagcuccgccugggcuacgagaccuucaaggucaucgaggggugguccaaccccaacagcaagcugcagaucaaccgccaggugaucguggaccggggcaaccgguccggguacucgggcaucuucuccgucgagggcaagagcugcaucaaccgcugcuucuacguggagcucauccgggggcgcaaggaggagaccgaggugcuguggaccucgaacuccaucgucguguucugcggcacgagcgggaccuacggcaccggguccuggccggacggcgccgacaucaaccugaugcccaucuga

SEQ ID NO: 23975 - RNA, 1410 nt, Artificial Sequence; identical to SEQ ID NO: 17114
  derived and/or modified CDS sequence (AUadapt) from InfluenzaA__AEX35541__NA

SEQ ID NO: 23976 - RNA, 1410 nt, Artificial Sequence
  derived and/or modified CDS sequence (AUadapt) from InfluenzaA__AEX35552__NA
augaaccccaaccagaagaucaucaccaucggcucggccucccugaccaucucgacgaucugcuucuucaugcagaucgccauccucaucaccaccgugacccugcacuucaagcaguacgaguucaacccgccgcccaacaaccaggcgaugcugugcgagcccacgaucaucgagcgcaacaucaccgagaucgucuaccucaccaacaccacgaucgagaaggagaucugccccaagcuggccgaguaccggaacugguccaagccccagugcgacaucaccggguucgcccccuucagcaaggacaacuccauccgccugucggccggcggggacaucugggugacccgggagcccuacguguccugcgacccggacaagugcuaccaguucgcccucggccaggggaccacgcugaacaacguccacagcaacgacaccgugcacgaccgcacccccuaccggacccugcucaugaacgagcugggcgugcccuuccaccugggcacgaagcaggucugcaucgcgugguccucguccucgugccacgacgggaaggccuggcuccacgugugcgugaccggcgacgacaagaacgccaccgccuccuucaucuacaacgggcgccuggucgacagcaucguguccuggucgaaggagauccugcggacccaggaguccgagugcgugugcaucaacggcacgugcaccgucgugaugaccgacgggagcgcguccggcaaggccgacaccaagauccucuucaucgaggagggcaagaucgugcacacgucgacccugagcggguccgcccagcacgucgaggagugcucgugcuacccccgcuacccgggcgugcggugcgugugccgcgacaacuggaagggguccaaccggcccaucgucgacaucaacaucaaggacuacucgaucgccuccagcuacgugugcuccggccuggugggcgacacgccccgcaagaacgacucguccagcuccucgcacugccucgaccccaacaacgaggagggcgggcacggggucaagggcugggccuucgacgacgggaacgacguguggaugggccggaccaucuccgagaagcugcgcucgggcuacgagaccuucaaggugaucgaggggugguccaacccgaacagcaagcugcagaucaaccggcaggucaucguggaccgcggcaaccgguccggguacucgggcaucuucuccgucgagggcaagagcugcaucaaccgcugcuucuacguggagcucauccgggggcgcaaggaggagaccgaggugcuguggaccucgaacuccaucgucguguucugcggcaccagcgggacguacggcaccggguccuggcccgacggcgcggacaucaaccugaugcccaucuga

SEQ ID NO: 23977 - RNA, 1410 nt, Artificial Sequence
  derived and/or modified CDS sequence (AUadapt) from InfluenzaA__AEX35563__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccucguucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaacgacuccucguccagcucccacugccucaaccccaacaacgaggagggcgggcacggggucaagggcugggccuucgacgacgggaacgacguguggaugggccggaccaucagcgagaagcugcgccugggcuacgagaccuucaaggucaucgaggggugguccaaccccaacucgaagcuccagaucaaccgccaggugaucguggaccggggcaaccgguccggguacagcggcaucuucuccgucgagggcaagucgugcaucaaccgcugcuucuacguggagcugauccgggggcgcaaggaggagaccgaggugcuguggaccagcaacuccaucgucguguucugcggcaccagcgggacguacggcaccggguccuggccggacggcgccgacaucaaccucaugcccaucuga

SEQ ID NO: 23978 - RNA, 1410 nt, Artificial Sequence; identical to SEQ ID NO: 23858
  derived and/or modified CDS sequence (AUadapt) from InfluenzaA__AEX35585__NA

SEQ ID NO: 23979 - RNA, 1410 nt, Artificial Sequence
  derived and/or modified CDS sequence (AUadapt) from InfluenzaA__AEX35596__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccgacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 23980 - RNA, 1410 nt, Artificial Sequence; identical to SEQ ID NO: 17114
  derived and/or modified CDS sequence (AUadapt) from InfluenzaA__AEX35607__NA

SEQ ID NO: 23981 - RNA, 1410 nt, Artificial Sequence
  derived and/or modified CDS sequence (AUadapt) from InfluenzaA__AEX35618__NA
augaaccccaaccagaagaucaucaccaucggcucggugucccugaccaucucgacgaucugcuucuucaugcagaucgccauccucaucaccaccgucacccugcacuucaagcaguacgagcugaacuccccgcccaacaaccaggugaugcucugcgagcccacgaucaucgagcgcaacaucaccgagaucguguaccugaccaacaccacgaucgagaaggagaccugccccaagcuggccgaguaccggaacuggagcaagccgcagugcuacaucaccggguucgcgcccuucuccaaggacaacucgauccgccucuccgccggcggggacaucugggucacccgggagcccuacgugagcugcgaccccgacaagugcuaccaguucgcccugggccaggggacgacccugaacaacgugcacuccaacgacaccguccgcgaccggaccccguaccgcacgcuccugaugaacgagcugggcgugcccuuccaccucggcaccaagcaggucugcaucgccuggucguccagcuccugccacgacgggaaggccuggcugcacgugugcaucaccggcgacgacaagaacgcgaccgccucguucaucuacaacgggcggcugguggacuccaucgugagcugguccaaggagauccuccgcacgcaggagucggagugcgucugcaucaacgggaccugcaccguggugaugaccgacggguccgccagcggcaaggccgacacgaagauccuguucaucgaggagggcaagaucguccacaccucgacccuguccgggagcgcgcagcacguggaggagugcuccugcuacccccgguaccccggcgugcgcugcgucugccgggacaacuggaaggggucgaaccgcccgaucguggacaucaacaucaaggaccacuccaucgugagcuccuacgucugcucgggccucgugggcgacacgccccggaagaacgacuccagcuccucgucccacugccuggaccccaacaacgaggagggcggccacggggugaagggcugggccuucgacgacgggaacgacgucuggaugggccgcaccaucagcgagaagucccggcugggcuacgagaccuucaaggugaucgagggguggucgaaccccaaguccaagcuccagaucaaccgccaggucaucguggaccgggacaaccgcagcggcuacuccgggaucuucucgguggagggcaagagcugcaucaaccggugcuucuacgucgagcugauccgcgggcggaaggaggagaccgaggugcuguggaccuccaacucgaucguggucuucugcggcacguccggcaccuacgggaccggcagcuggccggacggggccgacaucaaccucaugcccaucuga

SEQ ID NO: 23982 - RNA, 1410 nt, Artificial Sequence
  derived and/or modified CDS sequence (AUadapt) from InfluenzaA__AEX35640__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcgugaccggcgacaacaagaacgcgaccgccagcuucaucuacaacgggcggcugguggacuccaucgucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggcgcgggagcaaccggccgaucguggacaucaacaugaaggacuacuccaucgucucguccuacgugugcagcggccuggugggcgacacgccccgcaagaacgacuccucguccagcgggcacugccucgaccccaacgacgaggagggcgggcacggcgucaaggggugggccuucgacgacggcaacgacguguggaugggccggaccaucuccgagaagucccgcucgggguacgagaccuucaaggucaucgagggcuggagcaaccccaacuccaagcugcagaucaaccgccaggugaucguggaccgggggaaccggucgggcuacuccgggaucuucagcgucgagggcaagucgugcaucaaccgcugcuucuacguggagcugauccggggccgcaaggaggagaccgaggugcucuggaccuccaacagcaucgucguguucugcgggaccuccggcacguacgggaccggcagcuggccggacggggccgacaucaaccugaugcccaucuga

SEQ ID NO: 23983 - RNA, 1410 nt, Artificial Sequence
  derived and/or modified CDS sequence (AUadapt) from InfluenzaA__AEX35651__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgaggacaagucgugcaucaaccggugcuucuacguggagcucauccgcgggcggaaggaggagaccgaggugcuguggaccuccaacagcaucgucguguucugcggcaccuccggcacguacgggaccggcagcuggccggacggggccgacaucaaccugaugcccaucuga

SEQ ID NO: 23984 - RNA, 1410 nt, Artificial Sequence; identical to SEQ ID NO: 18286
  derived and/or modified CDS sequence (AUadapt) from InfluenzaA__AEX36105__NA

SEQ ID NO: 23985 - RNA, 1410 nt, Artificial Sequence
  derived and/or modified CDS sequence (AUadapt) from InfluenzaA__AEX36116__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcaaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcgaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 23986 - RNA, 1410 nt, Artificial Sequence
  derived and/or modified CDS sequence (AUadapt) from InfluenzaA__AEX36127__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggcugaagccgcagugcgacaucaccggguucgcgcccuucucgaaggacaacuccauccgccucagcgccggcggggacaucugggucacccgggagcccuacguguccugcgaccccgacaagugcuaccaguucgcccugggccaggggaccacgcugaacaacgugcacucgaacgacaccguccgcgaccggaccccguaccgcacccuccugaugaacgagcugggcgugcccuuccaccucggcacgaagcaggucugcaucgccugguccagcuccucgugccacgacgggaaggccuggcugcacgugugcaucaccggcgacgacaagaacgcgaccgccuccuucaucuacaacgggcggcugguggacagcguggucuccuggucgaaggagauccuccgcacccaggaguccgagugcgugugcaucaacggcacgugcaccguggucaugaccgacgggagcgccuccggcaaggccgacaccaagauccuguucaucgaggagggcaagaucgugcacacgucgacccugagcggguccgcgcagcacguggaggagugcagcugcuacccccgguaccccggcguccgcugcgugugccgggacaacuggaagggguccaaccgcccgaucguggacaucaacaucaaggaccacucgaucgucuccagcuacgugugcuccggccucgugggcgacacgccccggaagaacgacucguccagcuccucgcacugccuggaccccaacaacgaggagggcgggcacggggucaagggcugggccuucgacgacggggacgacguguggaugggccgcaccaucuccgagaagucccggcugggcuacgagaccuucaaggucaucgagggguggagcaaccccaagucgaagcuccagaucaaccgccaggugaucguggaccggggcaaccgcuccggguacagcggcaucuucuccgucgagggcaagucgugcaucaaccggugcuucuacguggagcugauccgcgggcggaaggaggagaccgaggugcuguggaccagcaacuccaucgucguguucugcggcaccagcgggacguacggcaccggguccuggccggacggcgccgacaucaaccucaugcccaucuga

SEQ ID NO: 23987 - RNA, 1410 nt, Artificial Sequence
  derived and/or modified CDS sequence (AUadapt) from InfluenzaA__AEX36149__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgaggacaagucgugcaucaaccggugcuucuacguggagcucauccgcgggcggaaggaggagaccgaggugcuguggaccaccaacuccaucgucguguucugcggcacgagcggcaccuacgggaccggcuccuggccggacggggccgacaucaaccugaugcccaucuga

SEQ ID NO: 23988 - RNA, 1410 nt, Artificial Sequence; identical to SEQ ID NO: 18914
  derived and/or modified CDS sequence (AUadapt) from InfluenzaA__AEX36160__NA

SEQ ID NO: 23989 - RNA, 1410 nt, Artificial Sequence
  derived and/or modified CDS sequence (AUadapt) from InfluenzaA__AEX36171__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugucggccggcggggacaucugggucacccgggagcccuacguguccugcgaccccgacaagugcuaccaguucgcccucggccaggggaccacgcugaacaacgugcacagcaacgacaccguccacaaccgcaccccguaccggacccugcucaugaacgagcugggcgugcccuuccaccugggcacgaagcaggucugcaucgccugguccucguccagcugccacgacgggaaggccuggcuccacgugugcgugaccggcgacgacaagaacgcgaccgccuccuucaucuacaacgggcgccugguggacagcaucgucuccuggucgaaggagauccugcggacccaggaguccgagugcgugugcaucaacggcacgugcgccguggucaugaccgacgggagcgccucgggcaaggcggacaccaagauccucuucaucgaggagggcaagaucgugcacaccuccacgcugagcggguccgcccagcacguggaggagugcucgugcuacccccgcuaccccggcguccggugcgugugccgcgacaacuggaagggguccaaccggccgaucguggacaucaacaucaaggacuacagcaucgucucccgcuacgugugcucgggccuggugggcgacacgccccggaagaacgacuccagcuccagcucccacugccucgaccccaacaacgaggagggcgggcacggggucaagggcugggccuucgacgacggggacgacguguggaugggccgcaccaucucggagaagucccggagcggcuacgagaccuucaaggucaucgaggggugguccaaccccaacucgaagcugcagaucaaccgccaggugaucguggaccggggcaaccgcuccggguacagcggcaucuucucggucgaggggaaguccugcaucaaccggugcuucuacguggagcugauccgcggccggaaggaggagaccgaggugcucuggaccagcaacuccaucgucguguucugcggcaccagcgggaccuacggcacgggguccuggccggacggcgccgacaucaaccugaugcccaucuga

SEQ ID NO: 23990 - RNA, 1410 nt, Artificial Sequence
  derived and/or modified CDS sequence (AUadapt) from InfluenzaA__AEX36193__NA
augaaccccaaccagaagaucaucaccaucggcucggugucccugaccaucagcacgaucugcuucuucaugcagaucgccauccucaucaccaccgucacccugcacuucaagcaguacgaguucaacuccucgccgaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgccguucagcaaggacaacuccauccgccugagcgccggcggggacaucugggucacccgggagcccuacguguccugcgaccccgacaagugcuaccaguucgcccucggccaggggaccacgcugaacaacgugcacucgaacaacaccguccgcgaccggacccccuaccgcacccugcucaugaacgagcugggcgugccguuccaccugggcacgaagcaggucugcaucgccugguccagcuccucgugccacgacgggaaggccuggcuccacgugugcaucaccggcgacgacaagaacgcgaccgccuccuucaucuacaacgggaugcugguggacagcaucguguccuggagcaaggagauccugcggacccaggaguccgagugcgucugcaucaacggcacgugcaccguggugaugaccgacgggucggccagcggcaaggccgacaccaagauccucuucaucgaggagggcaagaucguccacacguccacccugucgggguccgcgcagcacguggaggagugcagcugcuacccccgcuaccccggcgugcggugcgucugccgcgacaacuggaagggguccaaccggcccaucguggacaucaacaucaaggaccacagcaucguguccucguacgucugcuccggccuggugggcgacaccccgcgcaagaacgacagcuccucguccagccacugccucgaccccaacaacgaggagggcgggcacggggugaagggcugggccuucgacgacgggaacgacgucuggaugggccggaccaucuccgagaagucccgccugggcuacgagacguucaaggugaucgagggguggagcaaccccaagucgaagcugcagaucaaccggcaggucaucguggaccgcggcaaccgguccggguacagcggcaucuucucgguggaggggaaguccugcaucaaccgcugcuucuacgucgagcucauccggggccgcaaggaggagaccgaggugcuguggaccagcaacuccaucguggucuucugcggcaccagcgggacguacggcaccggguccuggcccgacggcgccgacaucaaccugaugccgaucuga

SEQ ID NO: 23991 - RNA, 1410 nt, Artificial Sequence
  derived and/or modified CDS sequence (AUadapt) from InfluenzaA__AEX36204__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccgccaucaucgagcgcaacaucacggagaucguguaccucaccaacaccaccaucgagaaggagaucugccccaagcuggcggaguaccggaacuggucgaagccgcagugcgacaucacgggguucgcccccuucuccaaggacaacagcauccgccuguccgccggcggggacaucugggucacccgggagcccuacgugucgugcgaccccgacaagugcuaccaguucgcccucggccaggggaccacccugaacaacgugcacuccaacgacacgguccacgagcgcaccccguaccggacccugcucaugaacgagcugggcgugcccuuccaccugggcaccaagcaggucugcaucgccuggagcuccucguccugccacgacgggaaggcguggcuccacgugugcgugacgggcgacgacaagaacgccaccgccagcuucaucuacaacgggcgccugguggacuccaucgucucgugguccaaggagauccugcggacccaggagagcgagugcgugugcaucaacgggaccugcacgguggucaugaccgacggguccgccucgggcaaggcggacaccaagauccucuucaucgaggagggcaagaucgugcacaccagcacgcuguccgggucggcccagcacguggaggagugcuccugcuacccccgcuaccccggcguccggugcgugugccgcgacaacuggaaggggagcaaccggccgaucguggacaucaacaucaaggacuacuccaucgucucgcgcuacgugugcuccggccuggugggcgacacgccccggaagaacgacagcuccucguccagccacugccucgaccccaacaacgaggagggcggccacggggucaagggcugggccuucgacgacgggaacgacguguggaugggccgcaccaucuccgagaagucccggucgggcuacgagaccuucaaggucaucgagggguggagcaaccccaacuccaagcugcagaucaaccgccaggugaucguggaccggggcaaccgcucgggguacuccggcaucuucagcgucgagggcaagucgugcaucaaccggugcuucuacguggagcugauccgcgggcggaaggaggagaccgaggugcucuggaccuccaacagcaucgucguguucugcggcaccuccgggaccuacggcacggggagcuggccggacggcgccgacaucaaccugaugcccaucuga

SEQ ID NO: 23992 - RNA, 1410 nt, Artificial Sequence
  derived and/or modified CDS sequence (AUadapt) from InfluenzaA__AEX36215__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccgccaucaucgagaagaacaucacggagaucguguaccucaccaacaccaccaucgagaaggagaucugccccaagcuggcggaguaccgcaacugguccaagccgcagugcgacaucacgggguucgcccccuucagcaaggacaacuccauccggcugucggccggcggggacaucugggucacccgcgagcccuacguguccugcgaccccgacaagugcuaccaguucgcccucggccaggggaccacccugaacaacgugcacagcaacgacacgguccacgagcggaccccguaccgcacccugcucaugaacgagcugggcgugcccuuccaccugggcaccaagcaggucugcaucgccugguccucguccagcugccacgacgggaaggcguggcuccacgugugcgugacgggcgacgacaagaacgccaccgccuccuucaucuacaacgggcggcugguggacagcaucgucuccuggucgaaggagauccugcgcacccaggaguccgagugcgugugcaucaacgggaccugcacgguggucaugaccgacgggagcgccucgggcaaggcggacaccaagauccucuucaucgaggagggcaagaucgugcacaccuccacgcugagcggguccgcccagcacguggaggagugcucgugcuacccccgguaccccggcguccgcugcgugugccgggacaacuggaagggguccaaccgcccgaucguggacaucaacaucaaggacuacagcaucgucucccgguacgugugcucgggccuggugggcgacacgccccgcaagaacgacuccagcuccagcucccacugccucgaccccaacaacgaggagggcggccacggggucaagggcugggccuucgacgacgggaacgacguguggaugggccggaccaucucggagaagucccgcagcggcuacgagaccuucaaggucaucgaggggugguccaaccccaacucgaagcugcagaucaaccgccaggugaucguggaccggggcaaccgguccggguacagcggcaucuucucggucgaggggaaguccugcaucaaccgcugcuucuacguggagcugauccggggccgcaaggaggagaccgaggugcucuggaccagcaacuccaucgucguguucugcggcaccagcgggaccuacggcacgggguccuggccggacggcgccgacaucaaccugaugcccaucuga

SEQ ID NO: 23993 - RNA, 1410 nt, Artificial Sequence
  derived and/or modified CDS sequence (AUadapt) from InfluenzaA__AEX36226__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccgccaucaucgagcgcaacaucacggagaucguguaccucaccaacaccaccaucgagaaggagaucugccccaagcuggcggaguaccggaacugguccaagccgcagugcgacaucacgggguucgcccccuucagcaaggacaacuccauccgccugucggccggcggggacaucugggucacccgggagcccuacguguccugcgaccccgacaagugcuaccaguucgcccucggccaggggaccacccugaacaacgugcacagcaacgacacgguccacaaccgcaccccguaccggacccugcucaugaacgagcugggcgugcccuuccaccugggcaccaagcaggucugcaucgccugguccucguccagcugccacgacgggaaggcguggcuccacgugugcgugacgggcgacgacaagaacgccaccgccuccuucaucuacaacgggcgccugguggacagcaucgucuccuggucgaaggagauccugcggacccaggaguccgagugcgugugcaucaacgggaccugcacgguggucaugaccgacgggagcgccucgggcaaggcggacaccaagauccucuucaucgaggagggcaagaucgugcacaccuccacgcugagcggguccgcccagcacguggaggagugcucgugcuacccccgcuaccccggcguccggugcgugugccgcgacaacuggaagggguccaaccggccgaucguggacaucaacaucaaggacuacagcaucgucucccgcuacgugugcucgggcaucgugggcgacacgccccggaagaacgacuccagcuccagcucccacugccuggaccccaacaacgaggagggcggccacggggucaagggcugggccuucgacgacgggaacgacguguggaugggccgcaccaucucggagaagucccggagcggcuacgagaccuucaaggucaucgaggggugguccaaccccaacucgaagcuccagaucaaccgccaggugaucguggaccggggcaaccgcuccggguacagcggcaucuucucggucgaggggaaguccugcaucaaccggugcuucuacguggagcugauccgcggccggaaggaggagaccgaggugcuguggaccagcaacuccaucgucguguucugcggcaccagcgggaccuacggcacgggguccuggccggacggcgccgacaucaaccucaugcccaucuga

SEQ ID NO: 23994 - RNA, 1410 nt, Artificial Sequence
  derived and/or modified CDS sequence (AUadapt) from InfluenzaA__AEX36237__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgagcggaccccguaccgcacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcggcugguggacuccaucgucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggcgcgggagcaaccggccgaucguggacaucaacaugaaggacuacuccaucgucucguccuacgugugcagcggccuggugggcgacacgccccgcaagaacgacuccucguccagcgggcacugccucgaccccaacgacgaggagggcgggcacggcgucaaggggugggccuucgacgacggcaacgacguguggaugggccggaccaucuccgagaagucccgcucgggguacgagaccuucaaggucaucgagggcuggagcaaccccaacuccaagcugcagaucaaccgccaggugaucguggaccgggggaaccggucgggcuacuccgggaucuucagcgucgagggcaagucgugcaucaaccgcugcuucuacguggagcugauccggggccgcaaggaggagaccgaggugcucuggaccuccaacagcaucgucguguucugcgggaccuccggcacguacgggaccggcagcuggccggacggggccgacaucaaccugaugcccaucuga

SEQ ID NO: 23995 - RNA, 1410 nt, Artificial Sequence
  derived and/or modified CDS sequence (AUadapt) from InfluenzaA__AEX36248__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccgccaucaucgagcgcaacaucacggagaucguguaccucaccaacaccaccaucgagaaggagaucugccccaagcuggcggaguaccggaacugguccaagccgcagugcgacaucacgggguucgcccccuucagcaaggacaacuccauccgccugucggccggcggggacaucugggucacccgggagcccuacguguccugcgaccccgacaagugcuaccaguucgcccucggccaggggaccacccugaacaacgugcacagcaacgacacgguccacaaccgcaccccguaccggacccugcucaugaacgagcugggcgugcccuuccaccugggcaccaagcaggucugcaucgccugguccucguccagcugccacgacgggaaggcguggcuccacgugugcgugacgggcgacgacaagaacgccaccgccuccuucaucuacaacgggcgccugguggacagcaucgucuccuggucgaaggagauccugcggacccaggaguccgagugcgugugcaucaacgggaccugcacgguggucaugaccgacgggagcgccucgggccgcgcggacaccaagauccucuucaucgaggagggcaagaucgugcacaccuccacgcugagcggguccgcccagcacguggaggagugcucgugcuacccccgguaccccggcguccgcugcgugugccgggacaacuggaagggguccaaccgcccgaucguggacaucaacaucaaggacuacagcaucgucucccgguacgugugcucgggccuggugggcgacacgccccgcaagaacgacuccagcuccagcucccacugccucgaccccaacaacgaggagggcggccacggggucaagggcugggccuucgacgacgggaacgacguguggaugggccggaccaucucggagaagucccgcagcggcuacgagaccuucaaggucaucgaggggugguccaaccccaacucgaagcugcagaucaaccgccaggugaucguggaccggggcaaccgguccggguacagcggcaucuucucggucgaggggaaguccugcaucaaccgcugcuucuacguggagcugauccggggccgcaaggaggagaccgaggugcucuggaccagcaacuccaucgucguguucugcggcaccagcgggaccuacggcacgggguccuggccggacggcgccgacaucaaccugaugcccaucuga

SEQ ID NO: 23996 - RNA, 1410 nt, Artificial Sequence; identical to SEQ ID NO: 18914
  derived and/or modified CDS sequence (AUadapt) from InfluenzaA__AEX36259__NA

SEQ ID NO: 23997 - RNA, 1410 nt, Artificial Sequence
  derived and/or modified CDS sequence (AUadapt) from InfluenzaA__AEX36270__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccgccaucaucgagcgcaacaucacggagaucguguaccucaccaacaccaccaucgagaaggagaucugccccaagcuggcggaguaccggaacugguccaagccgcagugcgacaucacgggguucgcccccuucagcaaggacaacuccauccgccugucggccggcggggacaucugggucacccgggagcccuacguguccugcgaccccgacaagugcuaccaguucgcccucggccaggggaccacccugaacaacgugcacagcaacgacacgguccacggccgcaccccguaccggacccugcucaugaacgagcugggcgugcccuuccaccuggggaccaagcaggucugcaucgccugguccucguccagcugccacgacggcaaggcguggcuccacgugugcgugacgggggacgacaagaacgccaccgccuccuucaucuacaacggccgccugguggacagcaucgucuccuggucgaaggagauccugcggacccaggaguccgagugcgugugcaucaacgggaccugcacgguggucaugaccgacggcagcgccucgggcaaggcggacaccaagauccucuucaucgaggaggggaagaucgugcacaccuccacgcugagcggcuccgcccagcacguggaggagugcucgugcuacccccgcuaccccgggguccggugcgugugccgcgacaacuggaagggcuccaaccggccgaucguggacaucaacaucaaggacuacagcaucgucucccgcuacgugugcucgggccuggugggggacacgccccggaagaacgacuccagcuccagcucccacugccucgaccccaacaacgaggagggcgggcacggcgucaaggggugggccuucgacgacggcaacgacguguggaugggccgcaccaucucggagaagucccggagcggguacgagaccuucaaggucaucgagggcugguccaaccccaacucgaagcugcagaucaaccgccaggugaucguggaccgggggaaccgcuccggcuacagcgggaucuucucggucgagggcaaguccugcaucaaccggugcuucuacguggagcugauccgcggccgggaggaggagaccaaggugcucuggaccagcaacuccaucgucguguucugcgggaccagcggcaccuacgggacgggcuccuggccggacggggccgacaucaaccugaugcccaucuga

SEQ ID NO: 23998 - RNA, 1410 nt, Artificial Sequence
  derived and/or modified CDS sequence (AUadapt) from InfluenzaA__AEX36281__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccgccaucaucgagcgcaacaucacggagaucguguaccucaccaacaccaccaucgagaaggagaucugccccaagcuggcggaguaccggaacugguccaagccgcagugcgacaucacgggguucgcccccuucagcaaggacaacuccauccgccugucggccggcggggacaucugggucacccgggagcccuacguguccugcgaccccgacaagugcuaccaguucgcccucggccaggggaccacccugaacaacgugcacagcaacgacacgguccacggccgcaccccguaccggacccugcucaugaacgagcugggcgugcccuuccaccuggggaccaagcaggucugcaucgccugguccucguccagcugccacgacggcaaggcguggcuccacgugugcgugacgggggacgacaagaacgccaccgccuccuucaucuacaacggccgccugguggacagcaucgucuccuggucgaaggagauccugcggacccaggaguccgagugcgugugcaucaacgggaccugcacgguggucaugaccgacggcagcgccucgggcaaggcggacaccaagauccucuucaucgaggaggggaagaucgugcacaccuccacgcugagcggcuccgcccagcacguggaggagugcucgugcuacccccgcuaccccgggguccggugcgugugccgcgacaacuggaagggcuccaaccggccgaucguggacaucaacaucaaggacuacagcaucgucucccgcuacgugugcucgggccuggugggggacacgccccggaagaacgacuccagcuccagcucccacugccucgaccccaacaacgaggagggcgggcacggcgucaaggggugggccuucgacgacggcaacgacguguggaugggccgcaccaucucggagaagucccggagcggguacgagaccuucaaggucaucgagggcugguccaaccccaacucgaagcugcagaucaaccgccaggugaucguggaccgggggaaccgcuccggcuacagcgggaucuucucggucgagggcaaguccugcaucaaccggugcuucuacguggagcugauccgcggccggaaggaggagaccgaggugcucuggaccagcaacuccaucgucguguucugcgggaccagcggcaccuacgggacgggcuccuggccggacggggccgacaucaaccugaugcccaucuga

SEQ ID NO: 23999 - RNA, 1410 nt, Artificial Sequence; identical to SEQ ID NO: 23998
  derived and/or modified CDS sequence (AUadapt) from InfluenzaA__AEX36292__NA

SEQ ID NO: 24000 - RNA, 1410 nt, Artificial Sequence
  derived and/or modified CDS sequence (AUadapt) from InfluenzaA__AEX36303__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccgccaucaucgagcgcaacaucacggagaucguguaccucaccaacaccaccaucgagaaggagaucugccccaagcuggcggaguaccggaacugguccaagccgcagugcgacaucacgggguucgcccccuucagcaaggacaacuccauccgccugucggccggcggggacaucugggucacccgggagcccuacguguccugcgaccccgacaagugcuaccaguucgcccucggccaggggaccacccugaacaacgugcacagcaacgacacgguccacgagcgcaccccguaccggacccugcucaugaacgagcugggcgugcccuuccaccugggcaccaagcaggucugcaucgccugguccucguccagcugccacgacgggaaggcguggcuccacgugugcgugacgggcgacgacaagaacgccaccgccuccuucaucuacaacgggcgccugguggacagcaucgucuccuggucgaaggagauccugcggacccaggaguccgagugcgugugcaucaacgggaccugcacgguggucaugaccgacgggagcgccucgggcaaggcggacaccaagauccucuucaucgaggagggcaagaucgugcacaccuccacgcugagcggguccgcccagcacguggaggagugcucgugcuacccccgcuaccccggcguccggugcgugugccgcgacaacuggaagggguccaaccggccgaucguggacaucaacaucaaggacuacagcaucgucucccgcuacgugugcucgggccuggugggcgacacgccccggaagaacgacuccagcuccagcucccacugccucgaccccaacaacgaggagggcggccacggggucaagggcugggccuucgacgacgggaacgacguguggaugggccgcaccaucucggagaagucccggagcggcuacgagaccuucaaggucaucgaggggugguccaaccccaacucgaagcugcagaucaaccgccaggugaucguggaccggggcaaccgcuccggguacagcggcaucuucucggucgaggggaaguccugcaucaaccggugcuucuacguggagcugauccgcggccggaaggaggagaccgaggugcucuggaccagcaacuccaucgucguguucugcggcaccagcgggaccuacggcacgggguccuggccggacggcgccgacaucaaccugaugcccaucuga

SEQ ID NO: 24001 - RNA, 1410 nt, Artificial Sequence
  derived and/or modified CDS sequence (AUadapt) from InfluenzaA__AEX36314__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugucggccggcggggacaucugggucacccgggagcccuacguguccugcgaccccgacaagugcuaccaguucgcccucggccaggggaccacgcugaacaacgugcacagcaacgacaccguccacaaccgcaccccguaccggacccugcucaugaacgagcugggcgugcccuuccaccugggcacgaagcaggucugcaucgccugguccucguccagcugccacgacgggaaggccuggcuccacgugugcgugaccggcgacgacaagaacgcgaccgccuccuucaucuacaacgggcgccugguggacagcaucgucuccuggucgaaggagauccugcggacccaggaguccgagugcgugugcaucaacggcacgugcgccguggucaugaccgacgggagcgccucgggcaaggcggacaccaagauccucuucaucgaggagggcaagaucgugcacaccuccacgcugagcggguccgcccagcacguggaggagugcucgugcuacccccgcuaccccggcguccggugcgugugccgcgacaacuggaagggguccaaccggccgaucguggacaucaacaucaaggacuacagcaucgucucccgcuacgugugcucgggccuggugggcgacacgccccggaagaacgacuccagcuccagcucccacugccucgaccccaacaacgaggagggggaccacggcgucaaggggugggccuucgacgacggcaacgacguguggauggggcgcaccaucucggagaagucccggagcggcuacgagaccuucaaggucaucgagggcugguccaaccccaacucgaagcugcagaucaaccgccaggugaucguggaccgggggaaccgcuccggcuacagcgggaucuucucggucgagggcaaguccugcaucaaccggugcuucuacguggagcugauccgcgggcggaaggaggagaccgaggugcucuggaccagcaacuccaucgucguguucugcggcaccagcggcaccuacgggacgggcuccuggccggacggggccgagaucaaccugaugcccaucuga

SEQ ID NO: 24002 - RNA, 1410 nt, Artificial Sequence; identical to SEQ ID NO: 23998
  derived and/or modified CDS sequence (AUadapt) from InfluenzaA__AEX36336__NA

SEQ ID NO: 24003 - RNA, 1410 nt, Artificial Sequence
  derived and/or modified CDS sequence (AUadapt) from InfluenzaA__AEX36347__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccaucaucaucgagcgcaacaucacggagaucguguaccucaccaacaccaccaucgagaaggagaucugccccaagcuggccgaguaccggaacugguccaagccgcagugcgacaucacgggguucgcgcccuucagcaaggacaacuccauccgccugagcgccggcggggacaucugggucacccgggagcccuacguguccugcgaccccgacaagugcuaccaguucgcccucggccaggggaccacccugaacaacgugcacucgaacgacacgguccacaaccgcaccccguaccggacccugcucaugaacgagcugggcgugcccuuccaccugggcaccaagcaggucugcaucgccugguccagcuccucgugccacgacgggaaggccuggcuccacgugugcgugacgggcgacgacaagaacgcgaccgccuccuucaucuacaacgggcgccugguggacagcaucgucuccuggagcaaggagauccugcggacccaggaguccgagugcgugugcaucaacgggaccugcgccguggucaugacggacgggucggccagcggcaaggcggacaccaagauccucuucaucgaggagggcaagaucgugcacgccuccacccugucgggguccgcccagcacguggaggagugcagcugcuacccccgcuaccccggcguccggugcgugugccgcgacaacuggaagggguccaaccggccgaucguggacaucaacaucaaggacuacagcaucgucucccgcuacgugugcucgggccuggugggcgacacgccccggaagaacgacuccagcuccucgucccacugccucgaccccaacaacgaggagggcggccacggggucaagggcugggccuucgacgacgggaacgacguguggaugggccgcaccaucagcgagaagucccggagcggcuacgagaccuucaaggucaucgaggggugguccaaccccaacucgaagcugcagaucaaccgccaggugaucguggaccggggcaaccgcuccggguacagcggcaucuucucggucgaggggaaguccugcaucaaccggugcuucuacguggagcugauccgcggccggaaggaggagaccgaggugcucuggaccagcaacuccaucgucguguucugcggcacgagcgggaccuacggcaccggguccuggccggacggcgccgacaucaaccugaugcccaucuga

SEQ ID NO: 24004 - RNA, 1410 nt, Artificial Sequence; identical to SEQ ID NO: 18286
  derived and/or modified CDS sequence (AUadapt) from InfluenzaA__AEX36358__NA

SEQ ID NO: 24005 - RNA, 1410 nt, Artificial Sequence
  derived and/or modified CDS sequence (AUadapt) from InfluenzaA__AEX36369__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcaaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggaccggggcaaccgcaccggguacucgggcaucuucuccguggagggcaagagcugcaucaaccggugcuucuacgucgagcucauccgcgggcggaaggaggagaccgaggugcuguggaccucgaacuccaucguggucuucugcggcacgagcgggaccuacggcaccggguccuggccggacggcgccgacaucaaccugaugcccaucuga

SEQ ID NO: 24006 - RNA, 1410 nt, Artificial Sequence
  derived and/or modified CDS sequence (AUadapt) from InfluenzaA__AEX36391__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucgcgggguucgcccccuucuccaaggacaacagcauccgccuguccgccggcggggacaucugggucacccgggagcccuacgugucgugcgaccccgacaagugcuaccaguucgcccucggccaggggaccacccugaacaacgugcacuccaacgacacgguccgcaaccggaccccguaccgcacccugcucaugaacgagcugggcgugcccuuccaccugggcaccaagcaggucugcaucgccuggagcuccucguccugccacgacgggaaggcguggcuccacgugugcaucacgggcgacgacaagaacgccaccgccagcuucaucuacaacgggcggcugguggacuccaucgugucgugguccaaggagauccugcgcacccaggagagcgagugcgucugcaucaacgggaccugcacgguggugaugaccgacggguccgccucgggcaaggcggacaccaagauccucuucaucgaggagggcaagaucguccacaccagcacgcuguccgggucggcccagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcggccacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggaccggggcgaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccuccgggaccuacggcacggggagcuggccggacggcgccgacaucaaccugaugcccaucuga

SEQ ID NO: 24007 - RNA, 1410 nt, Artificial Sequence
  derived and/or modified CDS sequence (AUadapt) from InfluenzaA__AEX36402__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcggccggaccccguaccgcacccugcucaugaacgagcugggcgugcccuuccaccuggggacgaagcaggucugcaucgccuggagcuccucguccugccacgacggcaaggccuggcuccacgugugcaucaccggggacgacaagaacgcgaccgccagcuucaucuacaacggccggcugguggacuccaucgugucgugguccaaggagauccugcgcacccaggagagcgagugcgucugcaucaacgggacgugcaccguggugaugaccgacggcuccgccucgggcaaggccgacaccaagauccucuucaucgaggaggggaagaucguccacacgagcacccuguccggcagcgcgcagcacguggaggagugcuccugcuacccccgguuccccggggugcgcugcgucugccgggacaacuggaagggcucgaaccgcccgaucguggacaucaacaucaaggaccacuccaucgugagcuccuacgucugcucgggccuggugggggacacgccccggaagaacgacuccagcuccucgucccacugccucgaccccaacaacgaggagggcgggcacggcgugaaggggugggccuucgacgacggcaacgacgucuggaugggccgcaccaucagcgagaagucccggcugggguacgagaccuucaaggugaucgagggcuggucgaaccccaaguccaagcugcagaucaaccgccaggucaucguggaccgggggaaccgcaccggcuacagcgggaucuucuccguggagggcaagucgugcaucaaccggugcuucuacgucgagcucauccgcggccggaaggaggagaccgaggugcuguggaccagcaacuccaucguggucuucugcgggacgagcggcaccuacgggaccggcuccuggccggacggggccgacaucaaccugaugcccaucuga

SEQ ID NO: 24008 - RNA, 1410 nt, Artificial Sequence; identical to SEQ ID NO: 18286
  derived and/or modified CDS sequence (AUadapt) from InfluenzaA__AEX36413__NA

SEQ ID NO: 24009 - RNA, 1410 nt, Artificial Sequence
  derived and/or modified CDS sequence (AUadapt) from InfluenzaA__AEX36424__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugcucgaagcuggccgaguaccggaacugguccaagccccagugcgacaucaccggguucgcgccguucagcaaggacaacuccauccgccugucggccggcggggacaucugggucacccgggagcccuacguguccugcgaccccgacaagugcuaccaguucgcccucggccaggggaccacgcugaacaacgugcacagcaacgacaccauccgcgaccggacccccuaccgcacccugcucaugaacgagcugggcgucccguuccaccugggcacgaagcaggucugcaucgccugguccucguccagcugccacgacgggaaggccuggcuccacgugugcaucaccggcgacgacaagaacgcgaccgccuccuucaucuacaacgggcggcugguggacagcgugguguccuggucgaaggagauccugcgcacccaggaguccgagugcgucugcaucaacggcacgugcaccguggugaugaccgacgggagcgccucgggcaaggccgacaccaagauccucuucaucgaggagggcaagaucguccacacguccacccugagcggguccgcgcagcacguggaggagugcucgugcuacccccgguaccccggcgugcgcugcgucugccgggacaacuggaagggguccaaccgccccaucguggacaucaacaucaaggaccacagcaucguguccucguacgucugcuccggccuggugggcgacaccccgcggaagaacgacagcuccagcuccucgcacugccucgaccccaacaacgaggagggcgggcacggggugaagggcugggccuucgacgacgggaacgacgucuggaugggccgcaccaucuccgagaagucccggcugggcuacgagacguucaaggugaucgagggguggagcaaccccaagucgaagcugcagaucaaccgccaggucaucguggaccggggcaaccgcuccggguacagcggcaucuucucgguggaggggaaguccugcaucaaccggugcuucuacgucgagcucauccgcggccggaaggaggagaccgaggugcuguggaccagcaacuccaucguggucuucugcggcaccagcgggacguacggcaccggguccuggcccgacggcgccgacaucaaccugaugccgaucuga

SEQ ID NO: 24010 - RNA, 1410 nt, Artificial Sequence
  derived and/or modified CDS sequence (AUadapt) from InfluenzaA__AEX36435__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucagcugguccaaggagauccugcgcacccaggagucggagugcgugugcaucaacggcacgugcaccguggucaugaccgacggguccgccagcggcaaggccgacaccaagauccucuucaucaaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaacuccaagucgaagcugcagaucaaccgccaggugaucguggaccggggcaaccgcuccggguacagcggcaucuucucggucgaggggaaguccugcaucaaccggugcuucuacguggagcucauccgcggccggaaggaggagaccgaggugcuguggaccagcaacuccaucgucguguucugcggcaccagcgggacguacggcaccggguccuggcccgacggcgccgacaucaaccugaugccgaucuga

SEQ ID NO: 24011 - RNA, 1410 nt, Artificial Sequence; identical to SEQ ID NO: 18468
  derived and/or modified CDS sequence (AUadapt) from InfluenzaA__AEX36446__NA

SEQ ID NO: 24012 - RNA, 1410 nt, Artificial Sequence; identical to SEQ ID NO: 18468
  derived and/or modified CDS sequence (AUadapt) from InfluenzaA__AEX36457__NA

SEQ ID NO: 24013 - RNA, 1410 nt, Artificial Sequence
  derived and/or modified CDS sequence (AUadapt) from InfluenzaA__AEX36468__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugucggccggcggggacaucugggucacccgggagcccuacguguccugcgaccccgacaagugcuaccaguucgcccucggccaggggaccacgcugaacaacgugcacagcaacgacaccguccacaaccgcaccccguaccggacccugcucaugaacgagcugggcgugcccuuccaccugggcacgaagcaggucugcaucgccugguccucguccagcugccacgacgggaaggccuggcuccacgugugcgugaccggcgacgacaagaacgcgaccgccuccuucaucuacaacgggcgccugguggacucgaucgucuccuggagcaaggagauccugcggacccaggaguccgagugcgugugcaucaacggcacgugcaccguggucaugaccgacgggucggccagcggcaaggccgacaccaagauccucuucaucgaggagggcaagaucgugcacacguccacccugucggggaacgcgcagcacguggaggagugcuccugcuacccccgcuaccccggcguccggugcgugugccgcgacaacuggaaggggagcaaccggccgaucguggacaucaacaucaaggacuacuccaucgucucgcgcuacgugugcuccggccuggugggcgacacgccccggaagaacgacagcuccucguccagccacugccucgaccccaacaacgaggagggcgggcacggggucaagggcugggccuucgacgacgggaacgacguguggaugggccgcaccaucuccgagaagucccggucgggcuacgagaccuucaaggucaucgagggguggagcaaccccaacuccaagcugcagaucaaccgccaggugaucguggaccggggcaaccgcucgggguacuccggcaucuucagcgucgagggcaagucgugcaucaaccggugcuucuacguggagcugauccgcgggcggaaggaggagaccaaggugcucuggaccuccaacagcaucgucguguucugcggcaccuccgggacguacggcaccgggagcuggccggacggcgccgacaucaaccugaugcccaucuga

SEQ ID NO: 24014 - RNA, 1410 nt, Artificial Sequence
  derived and/or modified CDS sequence (AUadapt) from InfluenzaA__AEX36479__NA
augaaccccaaccagaagaucaucaccaucggcucggugucccugaccaucucgacgaucugcuucuucaugcagaucgccauccucaucaccaccgucacccugcacuucaagcaguacgaguucuccagcccgcccaacaaccaggugaugcugugcgagcccacgaucaucgagcgcaacaucaccgagaucguguaccccaccaacaccacgaccgagaaggagaucugcccgaagcucgccgaguaccggaacugguccaagccccagugcgacaucaccggguucgcgcccuucucgaaggacaacuccauccgccugagcgccggcggggacaucugggucacccgggagcccuacguguccugcgacccggacaagugcuaccaguucgcccugggccaggggacgacccucaacaacgugcacucgaacgacaccguccacgaccgcacccccuaccggacgcugcugaugaacgagcucggcgugcccuuccaccugggcaccaagcaggucugcaucgccugguccagcuccucgugccacgacgggaaggccuggcugcacgugugcgugaccggcgacgacaagaacgcgaccgccuccuucaucuacaacgggcgccucguggacagcaucgucuccuggucgaaggagauccugcggacgcaggaguccgagugcgugugcaucaacgggaccugcaccguggucaugaccgacgggagcgccucgggcaaggccgacacgaagauccuguucaucgaggagggcaagaucgugcacaccuccacccucagcggguccgcgcagcacguggaggagugcucgugcuacccccgcuacccgggcguccggugcgugugccgcgacaacuggaagggguccaaccggcccaucguggacaucaacaucaaggacuacagcaucgucucccgcuacgugugcucgggccuggugggcgacacgccccggaagaacgacuccagcuccucgucccacugccuggaccccaacaacgaggagggcggccacggggucaagggcugggccuucgacgacgggaacgacguguggaugggccgcaccaucagcgagaagcuccgguccggcuacgagaccuucaaggucaucgagggguggucgaacccgaacuccaagcugcagaucaaccgccaggugaucguggaccggggcaaccgcagcggguacuccggcaucuucucggucgagggcaagagcugcaucaaccggugcuucuacguggagcugauccgcgggcggaaggaggagaccgaggugcucuggaccuccaacucgaucgucguguucugcggcacguccgggaccuacggcaccgggagcuggcccgacggcgccgacaucaaccugaugcccaucuga

SEQ ID NO: 24015 - RNA, 1410 nt, Artificial Sequence
  derived and/or modified CDS sequence (AUadapt) from InfluenzaA__AEX36490__NA
augaaccccaaccagaagaucaucaccaucggcucggugucccugaccaucagcacgaucugcuucuucaugcagaucgccauccucaucaccaccgucacccugcacuucaagcaguacgaguucuccuacccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggaacgcgcagcacguggaggagugcagcugcuacccccgcuaccccggcguccggugcgugugccgcgacaacuggaagggguccaaccggccgaucguggacaucaacaucaaggacuacucgaucgucucccgcuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggagcggcuacgagaccuucaaggucaucgaggggugguccaaccccaacucgaagcugcagaucaaccgccaggugaucguggaccggggcaaccgcuccggguacagcggcaucuucuccgucgagggcaagucgugcaucaaccggugcuucuacguggagcugauccgcgggcggaaggaggagaccaaggugcucuggaccagcaacuccaucgucguguucugcggcaccagcgggacguacggcaccggguccuggccggacggcgccgacaucaaccugaugcccaucuga

SEQ ID NO: 24016 - RNA, 1410 nt, Artificial Sequence
  derived and/or modified CDS sequence (AUadapt) from InfluenzaA__AEX36501__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccgccaucaucgagcgcaacaucacggagaucguguaccucaccaacaccaccaucgagaaggagaagugccccaagcuggcggaguaccggaacugguccaagccgcagugcgacaucacgggguucgcccccuucagcaaggacaacuccauccgccugucggccggcggggacaucugggucacccgggagcccuacguguccugcgaccccgacaagugcuaccaguucgcccucggccaggggaccacccugaacaacgugcacagcaacgacacgguccacggccgcaccccguaccggacccugcucaugaacgagcugggcgugcccuuccaccuggggaccaagcaggucugcaucgccugguccucguccagcugccacgacggcaaggcguggcuccacgugugcgugacgggggacgacaagaacgccaccgccuccuucaucuacaacggccgccugguggacucgaucgucuccuggagcaaggagauccugcggacccaggaguccgagugcgugugcaucaacgggaccugcacgguggucaugaccgacggcucggccagcggcaaggcggacaccaagauccucuucaucgaggaggggaagaucgugcacaccuccacgcugagcggcuccgcccagcacguggaggagugcucgugcuacccccgcuaccccgggguccggugcgugugccgcgacaacuggaagggcuccaaccggccgaucguggacaucaacaucaaggacuacagcaucgucucccgcuacgugugcucgggccuggugggggacacgccccggaaguccgacagcuccucguccagccacugccucgaccccaacaacgaggagggcgggcacggcgucaaggggugggccuucgacgacggcaacgacguguggaugggccgcaccaucuccgagaagucccggucgggguacgagaccuucaaggucaucgagggcuggagcaaccccaacuccaagcugcagaucaaccgccaggugaucguggaccgggggaaccgcucgggcuacagcgggaucuucuccgucgagggcaagucgugcaucaaccggugcuucuacguggagcugauccgcggccggaaggaggagaccgaggugcucuggaccuccaacagcaucgucguguucugcgggaccuccggcaccuacgggacgggcagcuggccggacggggccgacaucaaccugaugcccaucuga

SEQ ID NO: 24017 - RNA, 1410 nt, Artificial Sequence
  derived and/or modified CDS sequence (AUadapt) from InfluenzaA__AEX36512__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccgccaucaucgagcgcaacaucacggagaucguguaccucaccaacaccaccaucgagaaggagaucugccccaagcuggcggaguaccggaacugguccaagccgcagugcgacaucacgggguucgcccccuucagcaaggacaacuccauccgccugucggccggcggggacaucugggucacccgggagcccuacguguccugcgaccccgacaagugcuaccaguucgcccucggccaggggaccacccugaacaacgugcacagcaacgacacgguccacgaccgcaccccguaccggacccugcucaugaacgagcugggcgugcccuuccaccugggcaccaagcaggucugcaucgccugguccucguccagcugccacgacgggaaggcguggcuccacgugugcgugacgggcgacgacaagaacgccaccgccuccuucaucuacaacgggcgccugguggacagcaucgucuccuggucgaaggagauccugcggacccaggaguccgagugcgugugcaucaacgggaccugcacgguggucaugaccgacgggagcgccucgggcaaggcggacaccaagauccucuucaucgaggagggcaagaucgugcacaccuccacgcugagcggguccgcccagcacguggaggagugcucgugcuacccccgcuaccccggcguccggugcgugugccgcgacaacuggaagggguccaaccggccgaucguggacaucaacaucaaggacuacagcaucgucucccgcuacgugugcucgggccuggugggcgacacgccccggaagaacgacuccagcuccagcucccacugccucgaccccaacaacgaggagggcggccacggggucaagggcugggccuucgacgacgggaacgacguguggaugggccgcaccaucucggagaagucccggagcggcuacgagaccuucaaggucaucgaggggugguccaaccccaacucgaagcugcagaucaaccgccaggugaucguggaccggggcaaccgcuccggguacagcggcaucuucucggucgaggggaaguccugcaucaaccggugcuucuacguggagcugauccgcggccggaaggaggagaccgaggugcucuggaccagcaacuccaucgucguguucugcggcaccagcgggaccuacggcacgggguccuggccggacggcgccgacaucaaccugaugcccaucuga

SEQ ID NO: 24018 - RNA, 1410 nt, Artificial Sequence
  derived and/or modified CDS sequence (AUadapt) from InfluenzaA__AEX36523__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcgaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 24019 - RNA, 1410 nt, Artificial Sequence; identical to SEQ ID NO: 19001
  derived and/or modified CDS sequence (AUadapt) from InfluenzaA__AEX36534__NA

SEQ ID NO: 24020 - RNA, 1410 nt, Artificial Sequence
  derived and/or modified CDS sequence (AUadapt) from InfluenzaA__AEX36545__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgcccucggcaaggccgacaccaagauccuguucaucgaggagggcaagaucgugcacacgucgacccugagcggguccgcgcagcacguggaggagugcagcugcuacccccgguaccccggcguccgcugcgugugccgggacaacuggaagggguccaaccgcccgaucguggacaucaacaucaaggaccacucgaucgucuccagcuacgugugcuccggccucgugggcgacacgccccggaagaacgacucguccagcuccucgcacugccuggaccccaacaacgaggagggcgggcacggggucaagggcugggccuucgacgacgggaacgacguguggaugggccgcaccaucuccgagaagucccggcugggcuacgagaccuucaaggucaucgagggguggagcaaccccaagucgaagcuccagaucaaccgccaggugaucguggaccggggcaaccgcuccggguacagcggcaucuucuccgucgagggcaagucgugcaucaaccggugcuucuacguggagcugauccgcgggcggaaggaggagaccgaggugcuguggaccagcaacuccaucgucguguucugcggcaccagcgggacguacggcaccggguccuggccggacggcgccgacaucaaccucaugcccaucuga

SEQ ID NO: 24021 - RNA, 1410 nt, Artificial Sequence; identical to SEQ ID NO: 18914
  derived and/or modified CDS sequence (AUadapt) from InfluenzaA__AEX36556__NA

SEQ ID NO: 24022 - RNA, 1410 nt, Artificial Sequence; identical to SEQ ID NO: 18914
  derived and/or modified CDS sequence (AUadapt) from InfluenzaA__AEX36567__NA

SEQ ID NO: 24023 - RNA, 1410 nt, Artificial Sequence
  derived and/or modified CDS sequence (AUadapt) from InfluenzaA__AEX36578__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucaaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 24024 - RNA, 1410 nt, Artificial Sequence; identical to SEQ ID NO: 24023
  derived and/or modified CDS sequence (AUadapt) from InfluenzaA__AEX36589__NA

SEQ ID NO: 24025 - RNA, 1410 nt, Artificial Sequence
  derived and/or modified CDS sequence (AUadapt) from InfluenzaA__AEX36600__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucaaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacaacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 24026 - RNA, 1410 nt, Artificial Sequence; identical to SEQ ID NO: 17116
  derived and/or modified CDS sequence (AUadapt) from InfluenzaA__AEX36622__NA

SEQ ID NO: 24027 - RNA, 1410 nt, Artificial Sequence
  derived and/or modified CDS sequence (AUadapt) from InfluenzaA__AEX63619__NA
augaaccccaaccagaagaucaucaccaucggcucgaucugcaugaccaucgggaucgccucccugauccuccagaucggcaacaucaucagcaucuggaucucccacagcauccagacggagaaccagaaccagccggagaucugcaaccagaacgugaucaccuacgagaacaacaccugggucaaccagaccuacgugaacguguccaacacgaacuucgucgccgagcaggcgguggccagcgugaagcuggccgggaacuccucgcugugccccgucuccggcugggccaucuacagcaaggacaacuccgugcgcaucgggagcaagggcgacguguucgucauccgggagcccuucaucuccugcagccacuccgagugccgcaccuucuuccucacccagggcgcccugcugaacgacaagcacucgaacgggaccaucaaggaccggucccccuaccgcacgcucaugagcugcccgaucggcgaggugcccucccccuacaacagccgguucgagagcguggcgugguccgccucggccugccacgacgggaccuccuggcugaccaucggcaucagcgggcccgacaacggcgccgucgcggugcugaaguacaacggcaucaucaccgacacgaucaaguccuggcgcaagaacauccuccggacccaggagagcgagugcgccugcgugaacggguccugcuucaccgucaugaccgacggcccgagcaacgggcaggccuccuacaagguguucaagaucgagcgcggcaagguggucaagucgguggagcugaacgcccccaacuaccacuacgaggagugcuccugcuaccccgagagcuccgagaucacgugcgugugccgggacaacuggcacggcagcaaccgccccugggucuccuucaaccagaaccuggaguaccagaugggguacaucugcagcggcaucuucggggacaacccgcggcccaacgacaagaccggcuccugcgggcccguguucucgaacggcgccaacggcgugaagggguucuccuucaaguacggcaacggggucuggaucggccgcaccaagagcaccagcucccggaugggguucgagaugaucugggaccccgacggcuggacgaagaccgacgacaaguucagcgugaagcaggacaucaucggcaucaccgacugguccggguacucgggcuccuucguccagcacccggagcucaccgggcuggacugcaugcgccccugcuucuggguggagcugauccggggccgccccaaggagaacacgaucuggaccagcggguccagcaucuccuucugcggcgugaacagcgacaccgucggcugguccuggcccgacggggcggagcucccguucaccaucgacaaguga

SEQ ID NO: 24028 - RNA, 1365 nt, Artificial Sequence; identical to SEQ ID NO: 16322
  derived and/or modified CDS sequence (AUadapt) from InfluenzaA__AEX92876__NA

SEQ ID NO: 24029 - RNA, 1365 nt, Artificial Sequence; identical to SEQ ID NO: 16322
  derived and/or modified CDS sequence (AUadapt) from InfluenzaA__AEX92887__NA

SEQ ID NO: 24030 - RNA, 1365 nt, Artificial Sequence; identical to SEQ ID NO: 16322
  derived and/or modified CDS sequence (AUadapt) from InfluenzaA__AEX92904__NA

SEQ ID NO: 24031 - RNA, 1365 nt, Artificial Sequence; identical to SEQ ID NO: 16322
  derived and/or modified CDS sequence (AUadapt) from InfluenzaA__AEX96924__NA

SEQ ID NO: 24032 - RNA, 1410 nt, Artificial Sequence; identical to SEQ ID NO: 20871
  derived and/or modified CDS sequence (AUadapt) from InfluenzaA__AEY69091__NA

SEQ ID NO: 24033 - RNA, 1410 nt, Artificial Sequence; identical to SEQ ID NO: 19001
  derived and/or modified CDS sequence (AUadapt) from InfluenzaA__AEY69101__NA

SEQ ID NO: 24034 - RNA, 1410 nt, Artificial Sequence; identical to SEQ ID NO: 19001
  derived and/or modified CDS sequence (AUadapt) from InfluenzaA__AEY69112__NA

SEQ ID NO: 24035 - RNA, 1410 nt, Artificial Sequence
  derived and/or modified CDS sequence (AUadapt) from InfluenzaA__AEY69145__NA
augaacaccaaccagaagaucaucaccaucggcucggugucccugacgaucagcaccaucugcuucuucaugcagaucgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggucgaagccccagugcgacaucaccggguucgcgccguucuccaaggacaacagcauccgccuguccgccggcggggacaucugggucacccgggagcccuacgugucgugcgaccccgacaagugcuaccaguucgcccucggccaggggacgaccaucaacaacgugcacuccaacaacaccguccgcgaccggacccccuaccgcacgcugcugaugaacgagcucggcgugccguuccaccugggcaccaagcaggucugcaucgccuggagcuccucguccugccacgacgggaaggccuggcugcacgugugcaucaccggcgacgacaagaacgcgaccgccagcuucaucuacaacgggcggcucguggacuccguggucucgugguccaaggagauccugcgcacgcaggagagcgagugcgugugcaucaacgggaccugcaccguggucaugaccgacggguccgccucgggcaaggccgacacgaagauccuguucaucgaggagggcaagaucgugcacaccagcacccucuccgggucggcgcagcacguggaggagugcuccugcuacccccgguaccccggcguccgcugcgugugccgggacaacuggaaggggagcaaccgccccaucguggacaucaacaugaaggaccacuccaucgucucguccuacgugugcagcggccuggugggcgacaccccgcggaagaacgacuccucguccagcucccacugccuggaccccaacaacgaggagggcggccacggggucaagggcugggccuucgacgacgggaacgacguguggaugggccgcacgaucucggagaagucccggcucggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcugauccgcgggcggaaggaggagaccgaggugcucuggaccuccaacagcgucgugguguucugcggcacguccgggaccuacggcaccgggagcuggcccgacggcgccgacaucaaccugaugccgaucuga

SEQ ID NO: 24036 - RNA, 1410 nt, Artificial Sequence; identical to SEQ ID NO: 19001
  derived and/or modified CDS sequence (AUadapt) from InfluenzaA__AEY69156__NA

SEQ ID NO: 24037 - RNA, 1410 nt, Artificial Sequence
  derived and/or modified CDS sequence (AUadapt) from InfluenzaA__AEY69167__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccguguga

SEQ ID NO: 24038 - RNA, 1410 nt, Artificial Sequence; identical to SEQ ID NO: 24037
  derived and/or modified CDS sequence (AUadapt) from InfluenzaA__AEY69178__NA

SEQ ID NO: 24039 - RNA, 1410 nt, Artificial Sequence; identical to SEQ ID NO: 24037
  derived and/or modified CDS sequence (AUadapt) from InfluenzaA__AEY69189__NA

SEQ ID NO: 24040 - RNA, 1410 nt, Artificial Sequence
  derived and/or modified CDS sequence (AUadapt) from InfluenzaA__AEY69211__NA
augaaccccaaccagaagaucaucaccaucggcucggugucccugaccaucagcacgaucugcuucuucaugcagaucgccauccucaucaccaccgucacccugcacuucaagcaguacaaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccguguga

SEQ ID NO: 24041 - RNA, 1410 nt, Artificial Sequence; identical to SEQ ID NO: 24037
  derived and/or modified CDS sequence (AUadapt) from InfluenzaA__AEY69233__NA

SEQ ID NO: 24042 - RNA, 1410 nt, Artificial Sequence; identical to SEQ ID NO: 24037
  derived and/or modified CDS sequence (AUadapt) from InfluenzaA__AEY69272__NA

SEQ ID NO: 24043 - RNA, 1410 nt, Artificial Sequence; identical to SEQ ID NO: 24037
  derived and/or modified CDS sequence (AUadapt) from InfluenzaA__AEY69283__NA

SEQ ID NO: 24044 - RNA, 1410 nt, Artificial Sequence
  derived and/or modified CDS sequence (AUadapt) from InfluenzaA__AEY69294__NA
augaaccccaaccagaagaucaucaccaucggcucggugucccugaccaucucgacgaucugcuucuucaugcagaccgccauccucaucaccaccgucacgcugcacuucaagcagugcgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacgcaggagucggagugcgugugcaucaacgggaccugcaccguggucaugaccgacggguccgccagcggcaaggccgacacgaagauccucuucaucgaggagggcaagaucgugcacaccucgacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccucgucccacugccucgaccccaacaacgaggagggcggcaacggggucaagggcugggccuucgacgacgggaacgacguguggaugggccgcaccaucagcgagaagucccggcugggcuacgagaccuucaaggucaucgagggguggucgaaccccaaguccaagcugcagaucaaccgccaggugaucguggaccggggcaaccgcagcggguacuccggcaucuucucggucgagggcaagagcugcaucaaccggugcuucuacguggagcucauccgcgggcggaaggaggagaccgaggugcuguggaccuccaacucgaucgucguguucugcggcacguccgggaccuacggcaccgggagcuggccggacggcgccgacaucaaccugaugcccaucuga

SEQ ID NO: 24045 - RNA, 1410 nt, Artificial Sequence; identical to SEQ ID NO: 24044
  derived and/or modified CDS sequence (AUadapt) from InfluenzaA__AEY69305__NA

SEQ ID NO: 24046 - RNA, 1410 nt, Artificial Sequence; identical to SEQ ID NO: 24044
  derived and/or modified CDS sequence (AUadapt) from InfluenzaA__AEY69316__NA

SEQ ID NO: 24047 - RNA, 1410 nt, Artificial Sequence; identical to SEQ ID NO: 24044
  derived and/or modified CDS sequence (AUadapt) from InfluenzaA__AEY69788__NA

SEQ ID NO: 24048 - RNA, 1410 nt, Artificial Sequence; identical to SEQ ID NO: 19001
  derived and/or modified CDS sequence (AUadapt) from InfluenzaA__AEY69799__NA

SEQ ID NO: 24049 - RNA, 1410 nt, Artificial Sequence; identical to SEQ ID NO: 19001
  derived and/or modified CDS sequence (AUadapt) from InfluenzaA__AEY69810__NA

SEQ ID NO: 24050 - RNA, 1410 nt, Artificial Sequence; identical to SEQ ID NO: 24037
  derived and/or modified CDS sequence (AUadapt) from InfluenzaA__AEY69832__NA

SEQ ID NO: 24051 - RNA, 1410 nt, Artificial Sequence
  derived and/or modified CDS sequence (AUadapt) from InfluenzaA__AEY69843__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucgcgggcgacgacaagaacgccaccgccagcuucaucuacaacgggcggcugguggacuccguggucucgugguccaaggagauccugcgcacccaggagagcgagugcgugugcaucaacgggaccugcacgguggucaugaccgacggguccgccucgggcaaggcggacaccaagauccucuucaucgaggagggcaagaucgugcacaccagcacgcuguccgggucggcccagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcggccacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggaccuacggcacggggagcuggccggacggcgccgacaucaaccugaugcccguguga

SEQ ID NO: 24052 - RNA, 1410 nt, Artificial Sequence; identical to SEQ ID NO: 24037
  derived and/or modified CDS sequence (AUadapt) from InfluenzaA__AEY69854__NA

SEQ ID NO: 24053 - RNA, 1410 nt, Artificial Sequence; identical to SEQ ID NO: 24037
  derived and/or modified CDS sequence (AUadapt) from InfluenzaA__AEY69876__NA

SEQ ID NO: 24054 - RNA, 1410 nt, Artificial Sequence; identical to SEQ ID NO: 24037
  derived and/or modified CDS sequence (AUadapt) from InfluenzaA__AEY69887__NA

SEQ ID NO: 24055 - RNA, 1410 nt, Artificial Sequence; identical to SEQ ID NO: 24037
  derived and/or modified CDS sequence (AUadapt) from InfluenzaA__AEY69898__NA

SEQ ID NO: 24056 - RNA, 1410 nt, Artificial Sequence; identical to SEQ ID NO: 19001
  derived and/or modified CDS sequence (AUadapt) from InfluenzaA__AEY69909__NA

SEQ ID NO: 24057 - RNA, 1410 nt, Artificial Sequence
  derived and/or modified CDS sequence (AUadapt) from InfluenzaA__AEY69942__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgacggcggggacaucugggucacccgggagcccuacgugucgugcgaccccgacaagugcuaccaguucgcccucggccaggggaccacgcugaacaacauccacuccaacaacaccgugcgcgaccggaccccguaccgcacccugcucaugaacgagcugggcguccccuuccaccugggcacgaagcaggucugcaucgccuggagcuccucguccugccacgacgggaaggccuggcuccacgugugcaucaccggcgacgacaagaacgccaccgcgagcuucaucuacaacgggcggcugguggacuccguggugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcccagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggcguucgacgacgggaacgacgucuggaugggccgcaccaucucggagaagucccggcugggcuacgagaccuucaaggugaucgagggguggagcaaccccaaguccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccguguga

SEQ ID NO: 24058 - RNA, 1410 nt, Artificial Sequence; identical to SEQ ID NO: 24057
  derived and/or modified CDS sequence (AUadapt) from InfluenzaA__AEY69953__NA

SEQ ID NO: 24059 - RNA, 1410 nt, Artificial Sequence; identical to SEQ ID NO: 24057
  derived and/or modified CDS sequence (AUadapt) from InfluenzaA__AEY69964__NA

SEQ ID NO: 24060 - RNA, 1410 nt, Artificial Sequence; identical to SEQ ID NO: 24037
  derived and/or modified CDS sequence (AUadapt) from InfluenzaA__AEY69975__NA

SEQ ID NO: 24061 - RNA, 1410 nt, Artificial Sequence; identical to SEQ ID NO: 24037
  derived and/or modified CDS sequence (AUadapt) from InfluenzaA__AEY69986__NA

SEQ ID NO: 24062 - RNA, 1410 nt, Artificial Sequence; identical to SEQ ID NO: 24037
  derived and/or modified CDS sequence (AUadapt) from InfluenzaA__AEY69997__NA

SEQ ID NO: 24063 - RNA, 1410 nt, Artificial Sequence; identical to SEQ ID NO: 24037
  derived and/or modified CDS sequence (AUadapt) from InfluenzaA__AEY70008__NA

SEQ ID NO: 24064 - RNA, 1410 nt, Artificial Sequence; identical to SEQ ID NO: 24037
  derived and/or modified CDS sequence (AUadapt) from InfluenzaA__AEY70019__NA

SEQ ID NO: 24065 - RNA, 1410 nt, Artificial Sequence; identical to SEQ ID NO: 24037
  derived and/or modified CDS sequence (AUadapt) from InfluenzaA__AEY70259__NA

SEQ ID NO: 24066 - RNA, 1410 nt, Artificial Sequence; identical to SEQ ID NO: 24037
  derived and/or modified CDS sequence (AUadapt) from InfluenzaA__AEY70270__NA

SEQ ID NO: 24067 - RNA, 1410 nt, Artificial Sequence; identical to SEQ ID NO: 24037
  derived and/or modified CDS sequence (AUadapt) from InfluenzaA__AEY70281__NA

SEQ ID NO: 24068 - RNA, 1410 nt, Artificial Sequence; identical to SEQ ID NO: 19001
  derived and/or modified CDS sequence (AUadapt) from InfluenzaA__AEY70303__NA

SEQ ID NO: 24069 - RNA, 1410 nt, Artificial Sequence; identical to SEQ ID NO: 19001
  derived and/or modified CDS sequence (AUadapt) from InfluenzaA__AEY70314__NA

SEQ ID NO: 24070 - RNA, 1410 nt, Artificial Sequence
  derived and/or modified CDS sequence (AUadapt) from InfluenzaA__AEY70325__NA
augaaccccaaccagaagaucaucaccaucggcucggugucccugaccaucagcacgaucugcuucuucaugcagaucgccauccucaugaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugcccgaagcuggccgaguaccggaacugguccaagccccagugcgacaucaccggguucgcgcccuucucgaaggacaacuccauccgccugagcgccggcggggacaucugggucacccgggagcccuacguguccugcgacccggacaagugcuaccaguucgcccucggccaggggaccacgcugaacaacgugcacucgaacaacaccguccgcgaccggacccccuaccgcacccugcucaugaacgagcugggcgugcccuuccaccugggcacgaagcaggucugcaucgccugguccagcuccucgugccacgacgggaaggccuggcuccacgugugcaucaccggcgacgacaagaacgcgaccgccuccuucaucuacaacgggcggcugguggacagcguggucuccuggucgaaggagauccugcgcacccaggaguccgagugcgugugcaucaacggcacgugcaccguggucaugaccgacgggagcgccuccggcaaggccgacaccaagauccucuucaucgaggagggcaagaucgugcacacgucgacccugagcggguccgcgcagcacguggaggagugcucgugcuacccccgguacccgggcguccgcugcgugugccgggacaacuggaagggguccaaccgccccaucguggacaucaacaucaaggaccacagcaucgucuccucguacgugugcuccggccuggugggcgacacgccccggaagaacgacagcuccucguccagccacugccucgaccccaacaacgaggagggcgggcacggggucaagggcugggccuucgacgacgggaacgacguguggaugggccgcaccaucuccgagaagucccggcugggcuacgagaccuucaaggucaucgagggguggucgaaccccaagagcaagcugcagaucaaccgccaggugaucguggaccggggcaaccgcuccggguacucgggcaucuucuccgucgagggcaagagcugcaucaaccggugcuucuacguggagcucauccgcgggcggaaggaggagaccgaggugcuguggaccucgaacuccaucgucguguucugcggcaccagcgggacguacggcaccggguccuggcccgacggcgccgacaucaaccugaugcccguguga

SEQ ID NO: 24071 - RNA, 1410 nt, Artificial Sequence
  derived and/or modified CDS sequence (AUadapt) from InfluenzaA__AEY70336__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcaucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggaccggggcaaccgcucgggguacuccggcaucuucagcguggaggacaagucgugcaucaaccggugcuucuacgucgagcucauccgcgggcggaaggaggagaccgaggugcuguggaccuccaacagcaucguggucuucugcggcaccuccggcacguacgggaccggcagcuggccggacggggccgacaucaaccugaugcccguguga

SEQ ID NO: 24072 - RNA, 1410 nt, Artificial Sequence; identical to SEQ ID NO: 16318
  derived and/or modified CDS sequence (AUadapt) from InfluenzaA__AEY70358__NA

SEQ ID NO: 24073 - RNA, 1410 nt, Artificial Sequence; identical to SEQ ID NO: 19001
  derived and/or modified CDS sequence (AUadapt) from InfluenzaA__AEY70379__NA

SEQ ID NO: 24074 - RNA, 1410 nt, Artificial Sequence; identical to SEQ ID NO: 20763
  derived and/or modified CDS sequence (AUadapt) from InfluenzaA__AFB70139__NA

SEQ ID NO: 24075 - RNA, 1410 nt, Artificial Sequence; identical to SEQ ID NO: 16318
  derived and/or modified CDS sequence (AUadapt) from InfluenzaA__AFB70141__NA

SEQ ID NO: 24076 - RNA, 1410 nt, Artificial Sequence; identical to SEQ ID NO: 20763
  derived and/or modified CDS sequence (AUadapt) from InfluenzaA__AFB70147__NA

SEQ ID NO: 24077 - RNA, 1410 nt, Artificial Sequence; identical to SEQ ID NO: 16318
  derived and/or modified CDS sequence (AUadapt) from InfluenzaA__AFB70153__NA

SEQ ID NO: 24078 - RNA, 1410 nt, Artificial Sequence; identical to SEQ ID NO: 16318
  derived and/or modified CDS sequence (AUadapt) from InfluenzaA__AFB70155__NA

SEQ ID NO: 24079 - RNA, 1410 nt, Artificial Sequence; identical to SEQ ID NO: 20110
  derived and/or modified CDS sequence (AUadapt) from InfluenzaA__AFB70157__NA

SEQ ID NO: 24080 - RNA, 1410 nt, Artificial Sequence; identical to SEQ ID NO: 16318
  derived and/or modified CDS sequence (AUadapt) from InfluenzaA__AFB70159__NA

SEQ ID NO: 24081 - RNA, 1410 nt, Artificial Sequence
  derived and/or modified CDS sequence (AUadapt) from InfluenzaA__AFB70161__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcacgaagcaggacaucguggggaucaacgagugguccggcuacucgggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguacuggcccgacggcgccgagcugccguucaccaucgacaaguga

SEQ ID NO: 24082 - RNA, 1410 nt, Artificial Sequence
  derived and/or modified CDS sequence (AUadapt) from InfluenzaA__AFB70163__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacgccaucuggaccagcggguccagcaucuccuucugcggcgugaacagcgacaccgucgggugguccuggcccgacggcgcggagcugccguucaccaucgacaaguga

SEQ ID NO: 24083 - RNA, 1410 nt, Artificial Sequence
  derived and/or modified CDS sequence (AUadapt) from InfluenzaA__AFB70169__NA
augaaccccaaccagaagaucaucaccaucggcucggugugcaugaccaucgggauggccaaccugauccuccagaucggcaacaucaucuccaucuggaucaaccacagcauccagcuggggaaccagaaccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacucccgguucgagagcguggccuggagcgcguccgccugccacgacgggaucaacuggcucaccaucggcaucucgggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucucguucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggucguucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 24084 - RNA, 1410 nt, Artificial Sequence; identical to SEQ ID NO: 16318
  derived and/or modified CDS sequence (AUadapt) from InfluenzaA__AFB70199__NA

SEQ ID NO: 24085 - RNA, 1410 nt, Artificial Sequence; identical to SEQ ID NO: 16318
  derived and/or modified CDS sequence (AUadapt) from InfluenzaA__AFB70209__NA

SEQ ID NO: 24086 - RNA, 1410 nt, Artificial Sequence; identical to SEQ ID NO: 16318
  derived and/or modified CDS sequence (AUadapt) from InfluenzaA__AFB70219__NA

SEQ ID NO: 24087 - RNA, 1410 nt, Artificial Sequence; identical to SEQ ID NO: 16318
  derived and/or modified CDS sequence (AUadapt) from InfluenzaA__AFB70229__NA

SEQ ID NO: 24088 - RNA, 1410 nt, Artificial Sequence; identical to SEQ ID NO: 16318
  derived and/or modified CDS sequence (AUadapt) from InfluenzaA__AFB70239__NA

SEQ ID NO: 24089 - RNA, 1410 nt, Artificial Sequence; identical to SEQ ID NO: 16318
  derived and/or modified CDS sequence (AUadapt) from InfluenzaA__AFB70249__NA

SEQ ID NO: 24090 - RNA, 1410 nt, Artificial Sequence; identical to SEQ ID NO: 16318
  derived and/or modified CDS sequence (AUadapt) from InfluenzaA__AFB70259__NA

SEQ ID NO: 24091 - RNA, 1410 nt, Artificial Sequence; identical to SEQ ID NO: 20110
  derived and/or modified CDS sequence (AUadapt) from InfluenzaA__AFB70269__NA

SEQ ID NO: 24092 - RNA, 1410 nt, Artificial Sequence; identical to SEQ ID NO: 16318
  derived and/or modified CDS sequence (AUadapt) from InfluenzaA__AFB70279__NA

SEQ ID NO: 24093 - RNA, 1410 nt, Artificial Sequence; identical to SEQ ID NO: 16318
  derived and/or modified CDS sequence (AUadapt) from InfluenzaA__AFB70289__NA

SEQ ID NO: 24094 - RNA, 1410 nt, Artificial Sequence; identical to SEQ ID NO: 16318
  derived and/or modified CDS sequence (AUadapt) from InfluenzaA__AFB70299__NA

SEQ ID NO: 24095 - RNA, 1410 nt, Artificial Sequence; identical to SEQ ID NO: 16318
  derived and/or modified CDS sequence (AUadapt) from InfluenzaA__AFB70309__NA

SEQ ID NO: 24096 - RNA, 1410 nt, Artificial Sequence; identical to SEQ ID NO: 20763
  derived and/or modified CDS sequence (AUadapt) from InfluenzaA__AFB70319__NA

SEQ ID NO: 24097 - RNA, 1410 nt, Artificial Sequence; identical to SEQ ID NO: 16318
  derived and/or modified CDS sequence (AUadapt) from InfluenzaA__AFB70329__NA

SEQ ID NO: 24098 - RNA, 1410 nt, Artificial Sequence; identical to SEQ ID NO: 16318
  derived and/or modified CDS sequence (AUadapt) from InfluenzaA__AFB70349__NA

SEQ ID NO: 24099 - RNA, 1410 nt, Artificial Sequence; identical to SEQ ID NO: 16318
  derived and/or modified CDS sequence (AUadapt) from InfluenzaA__AFB70359__NA

SEQ ID NO: 24100 - RNA, 1410 nt, Artificial Sequence; identical to SEQ ID NO: 16318
  derived and/or modified CDS sequence (AUadapt) from InfluenzaA__AFB70369__NA

SEQ ID NO: 24101 - RNA, 1410 nt, Artificial Sequence; identical to SEQ ID NO: 16318
  derived and/or modified CDS sequence (AUadapt) from InfluenzaA__AFB70379__NA

SEQ ID NO: 24102 - RNA, 1410 nt, Artificial Sequence; identical to SEQ ID NO: 16318
  derived and/or modified CDS sequence (AUadapt) from InfluenzaA__AFB70389__NA

SEQ ID NO: 24103 - RNA, 1410 nt, Artificial Sequence; identical to SEQ ID NO: 16318
  derived and/or modified CDS sequence (AUadapt) from InfluenzaA__AFB70399__NA

SEQ ID NO: 24104 - RNA, 1410 nt, Artificial Sequence; identical to SEQ ID NO: 16318
  derived and/or modified CDS sequence (AUadapt) from InfluenzaA__AFB70409__NA

SEQ ID NO: 24105 - RNA, 1410 nt, Artificial Sequence
  derived and/or modified CDS sequence (AUadapt) from InfluenzaA__AFB77614__NA
augcaccccaaccaggaggugaucucgaucgucuccgugugcaugaccaucggcauggccaaccugauccuccagaucgggaacaucaucagcaucuggaucucccacagcauccagcugggcaaccagaaccagaucgagaccugcaaccaguccgugaucacguacgagaacaacaccugggucaaccagaccuacgugaacaucagcaacaccaacuucgccgcggggcaguccguggucagcgugaagcuggccggcaacuccagccucugcccgguguccgggugggccaucuacagcaaggacaacuccauccgcaucggcagcaagggcgacgucuucgugauccgggagcccuucaucuccugcagcccccuggagugccgcacguucuuccugacccagggggcccuccugaacgacaagcacuccaacggcaccaucaaggaccggucgcccuaccgcacccugauguccugcccgaucggggaggugcccagccccuacaacagccgguucgaguccgucgccuggagcgcguccgccugccacgacggcaucaacuggcucacgaucgggaucagcggccccgacaacggcgccguggccgugcugaaguacaacgggaucaucaccgacaccaucaaguccuggcgcaacaacauccugcggacccaggagagcgagugcgcgugcgucaacggcuccugcuucacgaucaugaccgacgggccgagcgacggccaggccuccuacaagaucuuccgcaucgagaagggcaagaucgucaagagcguggagaugaacgcccccaacuaccacuacgaggagugcuccugcuaccccgacagcuccgagaucacgugcgugugccgggacaacuggcacgggucgaaccgccccuggguguccuucaaccagaaccucgaguaccagaucggcuacaucugcagcgggaucuucggcgacaacccgcggcccaacgacaagaccggguccugcggccccgugagcuccaacggcgccaacggggucaagggcuucagcuucaaguacgggaacggcguguggaucgggcgcaccaagagcaucuccagccggaagggcuucgagaugaucugggaccccaacggcuggaccgggaccgacaacaacuucuccaucaagcaggacaucgugggcaucaacgaguggagcggguacuccggcagcuucguccagcacccggagcugaccgggcuggacugcauccgccccugcuucuggguggagcucauccggggccgccccaaggagaacacgaucuggaccuccggcagcuccaucagcuucugcggggucaacuccgacaccgugggcugguucuggcccgacggggccgagcugccguucaccaucgacaaguga

SEQ ID NO: 24106 - RNA, 1410 nt, Artificial Sequence
  derived and/or modified CDS sequence (AUadapt) from InfluenzaA__AFB77615__NA
augcaccccaaccaggagaucaucaccuucgugucggucugcaugaccaucggcauggccaaccugauccuccagaucgggaacaucaucuccaucuggaucagccacuccauccagcugggcaaccagaaccagaucgagacgugcaaccagagcgugaucaccuacgagaacaacaccugggugaaccagaccuacgucaacaucuccaacacgaacuucgccgcggggcagagcgugguguccgucaagcuggccggcaacagcucccucugcccggugagcgggugggccaucuacuccaaggacaacagcauccgcaucggcuccaagggcgacguguucgucauccgggagcccuucaucucgugcagcccccuggagugccgcaccuucuuccugacccagggggcccuccugaacgacaagcacuccaacggcaccaucaaggaccggucccccuaccgcacgcugaugagcugcccgaucggggaggugcccucccccuacaacagccgguucgagagcguggccugguccgcgagcgccugccacgacggcaucaacuggcucaccaucgggaucuccggccccgacaacggcgccgucgccgugcugaaguacaacgggaucaucaccgacaccaucaagagcuggcgcaacaacauccugcggacgcaggaguccgagugcgcgugcgugaacggcucgugcuucaccaucaugaccgacgggccguccgacggccaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucagcuucaaccagaaccucgaguaccagaucggcuacaucugcuccgggaucuucggcgacaacccgcggcccaacgacaagaccgggagcugcggccccguguccagcaacggcgccaacggggugaagggcuucuccuucaaguacgggaacggcgucuggaucgggcgcaccaagucgaucagcucccggaagggcuucgagaugaucugggaccccaacggcuggaccgggaccgacaacaacuucagcaucaagcaggacaucgugggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 24107 - RNA, 1410 nt, Artificial Sequence
  derived and/or modified CDS sequence (AUadapt) from InfluenzaA__AFB78128__NA
augaaccccaaccagaagaucaucaccaucggcucggugucccugaccaucgccacgaucugcuuccucaugcagaucgucauccuggugaccaccgugacccugcacuucaagcagcacgagugcaacucgccgcccaacaaccaggucaugcucugcgagcccacgaucaucgagcgcaacaucaccgagaucguguaccugaccaacaccacgaucgagaaggagaucugccccaagcuggccgaguaccggaacugguccaagccgcagugcaagaucaccggguucgcgcccuucagcaaggacaacuccauccgccucucggccggcggggacaucugggugacccgggagcccuacgucuccugcgaccccgacaagugcuaccaguucgcccugggccaggggaccacgcugaacaaccgccacagcaacgacaccgugcacgaccggaccccguaccgcacccuccugaugaacgagcugggcgugcccuuccaccucggcacgaagcaggucugcaucgccugguccucguccucgugccacgacgggaaggccuggcugcacgugugcgugaccggccacgacgagaacgcgaccgccuccuucaucuacgacgggcggcuggucgacagcaucggcuccuggucgaagaagauccuccgcacccaggaguccgagugcgugugcaucaacgggacgugcaccguggucaugaccgacggcagcgccuccggccgggccgacaccaagauccuguucaucgaggaggggaagaucgugcacacgucgaagcugucgggcuccgcgcagcacguggaggagugcagcugcuacccccgcuaccccgggguccggugcgugugccgcgacaacuggaagggcuccaaccggccgaucguggacaucaacgucaaggacuacucgaucguguccagcuacgugugcuccggccucgucggggacacgccccgcaagaacgacucguccucguccagccacugccuggaccccaacaacgaggagggcgggcacggcgugaaggggugggccuucgacgacggcaacgacgucuggaugggccggaccaucuccgagaagucccgcucgggguacgagaccuucaaggugaucgagggcuggagcaagcccaacuccaagcugcagaucaaccgccaggugaucgucgagcgggggaacaugucgggcuacuccgggaucuucucgguggagggcaagagcugcaucaaccggugcuucuacguggagcucauccgcggccggaagcaggagaccgaggucugguggaccuccaacucgaucgugguguucugcgggaccuccggcaccuacgggacgggcagcuggccggacggggccgacaucaaccugaugcccaucuga

SEQ ID NO: 24108 - RNA, 1410 nt, Artificial Sequence
  derived and/or modified CDS sequence (AUadapt) from InfluenzaA__AFC62078__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcuguucaucuccugcagcccccuggagugccgcaccuucuuccucacccagggcgcccugcugaacgacaagcacuccaacgggaccaucaaggaccggagccccuaccgcacgcucauguccugccccaucggcgaggucccgagccccuacaacucgcgguucgaguccguggccuggagcgcguccgccugccacgacgggaucaacuggcugaccaucggcaucagcggccccgacaacggggccguggccguccugaaguacaacggcaucaucaccgacaccaucaaguccuggcgcaacgacauccuccggacgcaggagagcgagugcgcgugcgugaacggguccugcuucaccaucaugaccgacggccccagcgacggccaggccuccuacaagaucuuccgcaucgagaaggggaagaucgucaagagcguggagaugaacgccccgaacuaccacuacgaggagugcuccugcuaccccgacucguccgagaucacgugcgugugccgggacaacuggcacggcagcaaccgccccuggguguccuucaaccagaaccuggaguaccagaucggguacaucugcagcggcaucuucggggacaacccccggccgaacgacaagaccggcuccugcggccccgucagcuccaacggggccaacggcgugaagggguucagcuucaaguacggcaacgggguguggaucggccgcaccaagagcaucuccucgcggaagggcuucgagaugaucugggaccccaacggguggaccggcaccgacaacaacuucuccaucaagcaggacaucgucgggaucaacgaguggagcggcuacuccgggagcuucgugcagcaccccgagcugacgggcauggacugcauccgcccgugcuucuggguggagcucauccggggccgccccaaggagaacaccaucuggaccuccgggagcuccaucagcuucugcggcgucaacuccgacaccgugggguggagcuggcccgacggcgccgagcugcccuucacgaucgacaaguga

SEQ ID NO: 24109 - RNA, 1410 nt, Artificial Sequence
  derived and/or modified CDS sequence (AUadapt) from InfluenzaA__AFC62079__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucaucaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcauccugggggacaacccgcggcccaacgacaagaccggcagcugcggccccgucuccucgaacggggccaacggcgugaagggguucuccuucaaguacggcaacggggugugggucggccgcaccaagagcaucagcucccggaacggcuucgagaugaucugggaccccaacggguggaccggcaccgacaacaacuucagcaucaagcaggacaucguggggaucaaggagugguccggcuacucgggguccuucgugcagcacccggagcugacgggccucgacugcauccgccccugcuucugggucgagcugauccggggccgccccaaggagaacaccaucuggaccagcggguccaucaucagcuucugcggcgugaacuccgacaccgucggguggagcuggcccgacggcgccgagcugccguucacgaucgacaaguga

SEQ ID NO: 24110 - RNA, 1410 nt, Artificial Sequence
  derived and/or modified CDS sequence (AUadapt) from InfluenzaA__AFC62080__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucgcgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuacuacuacgaggagugcuccugcuaccccgacucguccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccucgcggaagggcuucgagaugaucugggaccccaacggguggaccggcaccgacaacaacuucuccaucaagcaggacaucgucgggaucaacgaguggagcggcuacuccgggagcuucgugcagcacccggagcugacgggcaugggcugcauccgccccugcuucuggguggagcugauccgggggcgccccaaggagaacaccaucuggaccuccggcagcuccaucagcuucugcggggucaacuccgacaccgugggcuggagcuggcccgacggcgccgagcucccguucacgaucgacaaguga

SEQ ID NO: 24111 - RNA, 1410 nt, Artificial Sequence
  derived and/or modified CDS sequence (AUadapt) from InfluenzaA__AFC62082__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcggccggaccccguaccgcacccugcucaugaacgagcugggcgugcccuuccaccuggggacgaagcaggucugcaucgccuggucguccagcuccugccacgacggcaaggccuggcuccacgugugcaucaccggggacgacaagaacgcgaccgccucguucaucuacaacggccggcugguggacuccguggucagcugguccaaggagauccugcgcacccaggagagcgagugcgugugcaucaacgggacgugcaccguggucaugaccgacggcuccgccucgggcaaggccgacaccaagauccucuucaucgaggaggggaagaucgugcacacgagcacccuguccggcucggcgcagcacguggaggagugcuccugcuacccccgguaccccgggguccgcugcgugugccgggacaacuggaagggcagcaaccgcccgaucguggacaucaacaugaaggaccacuccaucgucagcuccuacgugugcucgggccuggugggggacacgccccggaagaacgacuccagcuccucgucccacugcuucgaccccaacgacgaggagggcgggcacggcgucaaggggugggccuucgacgacggcaacgacguguggaugggccgcaccaucagcgagaagucccggcucggguacgagaccuucaaggucaucgagggcuggagcaaccccaaguccaagcugcagaucaaccgccaggugaucguggaccgcggggaccggucgggcuacuccgggaucuucagcgucgagggcaagucgugcaucaaccggugcuucuacguggagcugauccgcggcuccaaggaggagaccgaggugcucuggaccagcaacuccaucgucguguucugcgggaccagcggcacguacgggaccggcuccuggccggacggggccgacaucaaccugaugcccaucuga

SEQ ID NO: 24112 - RNA, 1410 nt, Artificial Sequence; identical to SEQ ID NO: 16627
  derived and/or modified CDS sequence (AUadapt) from InfluenzaA__AFD63529__NA

SEQ ID NO: 24113 - RNA, 1410 nt, Artificial Sequence; identical to SEQ ID NO: 16627
  derived and/or modified CDS sequence (AUadapt) from InfluenzaA__AFD63540__NA

SEQ ID NO: 24114 - RNA, 1410 nt, Artificial Sequence
  derived and/or modified CDS sequence (AUadapt) from InfluenzaA__AFD63551__NA
augaaccccaaccagaagaucaucaccaucggcucggugucccugaccaucgccgccaucugcuuccucaugcagaucgcgauccuggucacgaccgugacccugcacuucaagcagcacgagugcaacccgccgcccaacaaccaggugaugcucugcgagcccaccaucaucgagcgcaacaucacggagaucgucuaccugaccaacaccaccaucgagaaggagaucugccccaagcuggccgaguaccggaacuggucgaagccccagugcaacaucacgggguucgcccccuucuccaaggacaacagcauccgccucuccgccggcggggacaucugggugacccgggagcccuacgugucgugcgacccggacaagugcuaccaguucgcccugggccaggggaccacccugaacaacggccacuccaacgacacgguccacggccgcacccccuaccggacccuccugaugaacgagcugggggugcccuuccaccucggcacccgccaggugugcaucgcguggucguccagcuccugccacgacgggaaggccuggcugcacgucugcgugacgggcgacgacaagaacgccaccgccucguucaucuacaacgggcggcugguggacuccaucggcagcugguccaagaagauccuccgcacccaggagucggagugcgucugcaucaacgggaccugcacgguggugaugaccgacggguccgcgucgggcaaggccgacaccaagauccuguucaucgaggaggggaagaucguccacaucuccacccugagcggcucggcccagcacguggaggagugcuccugcuacccccgguacccgggcgugcgcugcgucugccgggacaacuggaaggggagcaaccgccccaucguggacaucaacgugaaggacuacuccaucgucucguccuacgugugcucgggccucgugggggacacgccccggaagaacgacuccuucagcuccucgcacugccuggaccccaacaacgaggagggcgggcacggcgucaagggcugggccuucgacgacgggaacgacguguggaugggccgcaccaucuccgagaagcugcggagcggguacgagaccuucaaggucaucgagggcugguccaagccgaacucgaagcuccagaucaaccgccaggugaucguggagcgggggaaccgcuccggcuacucgggcaucuucuccgucgagggcaagagcugcaucaaccggugcuucuacguggagcugauccgcggccggaaggaggagaccgaggugugguggacguccaacucgaucgucguguucugcgggaccagcggcaccuacgggaccggcuccuggcccgacggcgccgacaucaaccugaugcccaucuga

SEQ ID NO: 24115 - RNA, 1410 nt, Artificial Sequence; identical to SEQ ID NO: 16627
  derived and/or modified CDS sequence (AUadapt) from InfluenzaA__AFD63562__NA

SEQ ID NO: 24116 - RNA, 1410 nt, Artificial Sequence
  derived and/or modified CDS sequence (AUadapt) from InfluenzaA__AFD63573__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgggcgcaacaucaccgagaucgucuaccugaccaacaccacgaucgagaaggagaucugccccaagcuggcggaguaccggaacugguccaagccgcagugcaacaucaccggcuucgcccccuucagcaaggacaacuccauccgccucucggccgggggcgacaucugggugacccgggagcccuacguguccugcgaccccgacaagugcuaccaguucgcccuggggcagggcaccacgcugaacaacggccacagcaacgacaccguccacgaccgcaccccguaccggacccuccugaugaacgagcugggggugcccuuccaccucggcacgcgccaggugugcaucgccugguccucguccucgugccacgacgggaaggcguggcugcacgucugcgugaccggcgacgacaagaacgccaccgccuccuucaucuacaacgggcggcugguggacagcaucggcuccuggucgaagaagauccuccgcacccaggaguccgagugcgucugcaucaacggcacgugcaccguggugaugaccgacgggagcgccuccggcaaggcggacaccaagauccuguucaucgaggaggggaagaucguccacaucucgacgcugagcggcuccgcccagcacguggaggagugcucgugcuacccccgguaccccggcgugcgcugcgucugccgggacaacuggaagggguccaaccgcccgaucguggacaucaacgugaaggacuacucgaucgucuccagcuacgugugcuccggccucgugggggacacgccccggaagaacgacucguucuccagcucccacugccuggaccccaacaacgaggagggcgggcacggcgucaagggcugggccuucgacgacgggaacgacguguggaugggccgcaccaucucggagaagcugcgguccggguacgagaccuucaaggucaucgagggcuggucgaagcccaacuccaagcuccagaucaaccgccaggugaucguggagcgggggaaccgcagcggcuacuccggcaucuucucggucgaggggaaguccugcaucaaccggugcuucuacguggagcugauccgcggccggaaggaggagaccgaggugugguggaccagcaacucgaucgucguguucugcgggaccuccggcaccuacgggacgggcagcuggccggacggcgccgacaucaaccugaugcccaucuga

SEQ ID NO: 24117 - RNA, 1410 nt, Artificial Sequence
  derived and/or modified CDS sequence (AUadapt) from InfluenzaA__AFD63584__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgagcgcaccccguaccggacccuccugaugaacgagcugggcgugcccuuccaccucgggacgcgccaggugugcaucgccugguccucguccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucauccacaucucgacgcugagcggguccgcccagcacgucgaggagugcucgugcuacccccgguaccccggcgugcgcugcgugugccgggacaacuggaagggcuccaaccgcccgaucgucgacaucaacgugaaggacuacucgaucguguccagcuacgucugcuccgggcucgugggcgacacgccccggaagaacgacucguccagcuccucgcacugccuggaccccaacaacgaggagggcgggcacggggugaagggcugggccuucgacgacggcaacgacgucuggauggggcgcaccaucuccgagaagcugcggucgggcuacgagaccuucaaggugaucgaggggugguccaagcccaacagcaagcuccagaucaaccgccaggucaucguggagcggggcaaccgcuccggguacucgggcaucuucuccguggagggcaagagcugcaucaaccggugcuucuacgucgagcugauccgcgggcggaaggaggagaccgaggugugguggaccucgaacuccaucguggucuucugcggcaccagcgggaccuacggcacgggguccuggccggacggcgccgacaucaaccugaugcccaucuga

SEQ ID NO: 24118 - RNA, 1410 nt, Artificial Sequence
  derived and/or modified CDS sequence (AUadapt) from InfluenzaA__AFD63595__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccucgugccacgacggcaaggccuggcugcacgucugcgugacgggggacgacaagaacgccaccgccuccuucaucuacaacggccggcugguggacagcaucggguccuggucgaagaagauccuccgcacccaggaguccgagugcgucugcaucaacgggaccugcacgguggugaugaccgacggcagcgcguccgggaaggccgacaccaagauccuguucaucgaggagggcaagaucguccacaucucgacccugagcggguccgcccagcacguggaggagugcucgugcuacccccgguaccccggcgugcgcugcgucugcaaggacaacuggaagggcuccaaccggccgaucguggacaucaacgugaaggacuacucgaucgucuccagcuacgugugcuccgggcucgugggcgacacgccccgcaagaacgacucguucuccagcucccacugccuggaccccaacaacgaggagggcggccacggggucaagggcugggccuucgacgacggcaacgacguguggauggggcggaccaucucggagaagcugcgcuccggcuacgagaccuucaaggucaucgagggguggucgaagcccaacuccaagcuccagaucaaccgccaggugaucguggagcggggcaaccggagcggguacuccggcaucuucucggucgagggcaaguccugcaucaaccgcugcuucuacguggagcugauccgggggcgcaaggaggagaccgaggugugguggacgagcaacucgaucgucguguucugcggcaccuccgggaccuacggcaccgggagcuggccggacggcgccgacaucaaccugaugcccaucuga

SEQ ID NO: 24119 - RNA, 1410 nt, Artificial Sequence; identical to SEQ ID NO: 16627
  derived and/or modified CDS sequence (AUadapt) from InfluenzaA__AFD63606__NA

SEQ ID NO: 24120 - RNA, 1410 nt, Artificial Sequence; identical to SEQ ID NO: 16547
  derived and/or modified CDS sequence (AUadapt) from InfluenzaA__AFD63628__NA

SEQ ID NO: 24121 - RNA, 1410 nt, Artificial Sequence; identical to SEQ ID NO: 16627
  derived and/or modified CDS sequence (AUadapt) from InfluenzaA__AFD63639__NA

SEQ ID NO: 24122 - RNA, 1410 nt, Artificial Sequence; identical to SEQ ID NO: 16627
  derived and/or modified CDS sequence (AUadapt) from InfluenzaA__AFD63650__NA

SEQ ID NO: 24123 - RNA, 1410 nt, Artificial Sequence
  derived and/or modified CDS sequence (AUadapt) from InfluenzaA__AFD63661__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacuccaccaucgagaaggagaucugccccaagcuggccgaguaccggaacuggagcaagccgcagugcaacaucaccggguucgcccccuucuccaaggacaacucgauccgccucuccgccggcggggacaucugggugacgcgggagcccuacgugagcugcgaccccgacaagugcuaccaguucgcccugggccaggggaccacccugaacaacggccacuccaacgacaccguccacgaccgcacgccguaccggacccuccugaugaacgagcugggcgugcccuuccaccucgggacccgccaggugugcaucgcguggucguccagcuccugccacgacggcaaggccuggcugcacgucugcgugaccggggacgacaagaacgccacggccucguucaucuacaacggccggcugguggacuccaucgggagcugguccaagaagauccuccgcacccaggagucggagugcgucugcaucaacgggaccugcaccguggugaugacggacggcuccgcgagcgggaaggccgacaccaagauccuguucaucgaggagggcaagaucguccacaucucgacccuguccgggucggcccagcacguggaggagugcuccugcuacccccgguaccccggcgugcgcugcgucugccgggacaacuggaagggcagcaaccgcccgaucguggacaucaacgugaaggacuacuccaucgucucguccuacgugugcagcgggcucgugggcgacacgccccggaagaacgacuccuucucguccagccacugccuggaccccaacaacgaggagggcggccacggggucaagggcugggccuucgacgacggcaacgacguguggauggggcgcaccaucuccgagaagcugcggucgggcuacgagaccuucaaggucaucgaggggugguccaagcccaacagcaagcuccagaucaaccgccaggugaucguggagcggggcaaccgcuccggguacucgggcaucuucuccgucgagggcaagagcugcaucaaccggugcuucuacguggagcugauccgcgggcggaaggaggagaccgaggugugguggaccucgaacuccaucgucguguucugcggcacgagcgggaccuacggcaccggguccuggccggacggcgccgacaucaaccugaugcccaucuga

SEQ ID NO: 24124 - RNA, 1410 nt, Artificial Sequence; identical to SEQ ID NO: 18333
  derived and/or modified CDS sequence (AUadapt) from InfluenzaA__AFD63672__NA

SEQ ID NO: 24125 - RNA, 1410 nt, Artificial Sequence
  derived and/or modified CDS sequence (AUadapt) from InfluenzaA__AFD63683__NA
augaaccccaaccagaagaucaucaccaugggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacggccgcaccccguaccggacccuccugaugaacgagcugggggugcccuuccaccucggcacgcgccaggugugcaucgccugguccucguccucgugccacgacgggaaggcguggcugcacgucugcgugaccggcgacgacaagaacgccaccgccuccuucaucuacaacgggcggcugguggacagcaucggcuccuggucgaagaagauccuccgcacccaggaguccgagugcgucugcaucaacggcacgugcaccguggugaugaccgacgggagcgccuccggcaaggcggacaccaagauccuguucaucgaggaggggaagaucauccacaucucgacgcugagcggcuccgcccagcacgucgaggagugcucgugcuacccccgguaccccggcgugcgcugcgugugccgggacaacuggaagggguccaaccgcccgaucgucgacaucaacgugaaggacuacucgaucguguccagcuacgucugcuccggccucgugggggacacgccccggaagaacgacucguccagcuccucgcacugccuggaccccaacaacgaggagggcgggcacggcgugaagggcugggccuucgacgacgggaacgacgucuggaugggccgcaccaucuccgagaagcugcggucgggguacgagaccuucaaggugaucgagggcugguccaagcccaacagcaagcuccagaucaaccgccaggucaucguggagcgggggaaccgcuccggcuacucgggcaucuucuccguggagggcaagagcugcaucaaccggugcuucuacgucgagcugauccgcgggcggaaggaggagaccgaggugugguggaccucgaacuccaucguggucuucugcgggaccagcggcaccuacgggacgggcuccuggccggacggcgccgacaucaaccugaugcccaucuga

SEQ ID NO: 24126 - RNA, 1410 nt, Artificial Sequence
  derived and/or modified CDS sequence (AUadapt) from InfluenzaA__AFD63694__NA
augaaccccaaccagaagaucaucaccaucggcucggugucccugaccaucgccacgaucugcuuccucaugcagaucgccauccuggucaccaccaucacccugcacuucaagcagcacgagugcaacucgccgcccaacaaccaggugaugcucugcgagcccacgaucaucgagcgcaacaucaccgagaucguguaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggucacccgggagcccuacguguccugcgaccccgacaagugcuaccaguucgcccugggccaggggaccacgcugaacaacggccacagcaacgacaccgugcacgaccgcaccccguaccggacccuccugaugaacgagcugggcguccccuuccaccucgggacgcgccaggugugcaucgccugguccucguccucgugccacgacggcaaggcguggcugcacgugugcgucaccggggacgacaagaacgccaccgccuccuucaucuacaacggccggcugguggacagcaucggguccuggucgaagaagauccuccgcacccaggaguccgagugcgugugcaucaacggcacgugcaccgucgugaugaccgacggcagcgccuccgggaaggcggacaccaagauccuguucaucgaggagggcaagaucgugcacaucucgacgcugagcggguccgcccagcacgucgaggagugcucgugcuacccccgguaccccggcgugcgcugcgugugccgggacaacuggaagggcuccaaccgcccgaucgucgacaucaacgugaaggacuacucgaucguguccagcuacgucugcuccgggcucgugggcgacacgccccggaagaacgacucguucuccagcucccacugccuggaccccaacaacgaggagggcgggcacggggugaagggcugggccuucgacgacggcaacgacgucuggauggggcgcaccaucucggagaagcugcgguccggcuacgagaccuucaaggugaucgagggguggucgaagcccaacuccaagcuccagaucaaccgccaggucaucguggagcggggcaaccgcagcggguacuccggcaucuucucgguggagggcaaguccugcaucaaccggugcuucuacgucgagcugauccgcgggcggaaggaggagaccgaggugugguggaccagcaacucgaucguggucuucugcggcaccuccgggaccuacggcacggggagcuggccggacggcgccgacaucaaccugaugcccaucuga

SEQ ID NO: 24127 - RNA, 1410 nt, Artificial Sequence
  derived and/or modified CDS sequence (AUadapt) from InfluenzaA__AFD63705__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggcaaggggaccacccugaacaacggccacagcaacgacacgguccacgaccgcaccccguaccggacccuccugaugaacgagcugggcgugcccuuccaccucgggacccgccaggugugcaucgcgugguccucguccucgugccacgacggcaaggccuggcugcacgucugcgugacgggggacgacaagaacgccaccgccuccuucaucuacaacggccggcugguggacagcaucggguccuggucgaagaagauccuccgcacccaggaguccgagugcgucugcaucaacgggaccugcacgguggugaugaccgacggcagcgcguccgggaaggccgacaccaagauccuguucaucgaggagggcaagaucguccacaucucgacccugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcggccacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggacgagcaacucgaucgucguguucugcggcaccuccgggaccuacggcaccgggagcuggccggacggcgccgacaucaaccugaugcccaucuga

SEQ ID NO: 24128 - RNA, 1410 nt, Artificial Sequence
  derived and/or modified CDS sequence (AUadapt) from InfluenzaA__AFD63716__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugccaccaguucgcccugggccaggggaccacccugaacaacggccacucgaacgacacgguccacgaccgcaccccguaccggacccuccugaugaacgagcugggcgugcccuuccaccucgggacccgccaggugugcaucgcgugguccagcuccucgugccacgacggcaaggccuggcugcacgucugcgugacgggggacgacaagaacgccaccgccuccuucaucuacaacggccggcugguggacagcaucggguccuggucgaagaagauccuccgcacccaggaguccgagugcgucugcaucaacgggaccugcacgguggugaugaccgacggcucggcguccgggaaggccgacaccaagauccuguucaucgaggagggcaagaucguccacaucagcacccugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcggccacggggucaagggcugggccuucgacgacggcaacgacguguggauggggcgcaccaucucggagaagcugcgguccggcuacgagaccuucaaggucaucgagggguggagcaagcccaacuccaagcuccagaucaaccgccaggugaucguggagcggggcaaccgcucgggguacuccggcaucuucucggucgagggcaaguccugcaucaaccggugcuucuacguggagcugauccgcgggcggaaggaggagaccgaggugugguggacgagcaacucgaucgucguguucugcggcaccuccgggaccuacggcaccgggagcuggccggacggcgccgacaucaaccugaugcccaucuga

SEQ ID NO: 24129 - RNA, 1410 nt, Artificial Sequence; identical to SEQ ID NO: 16627
  derived and/or modified CDS sequence (AUadapt) from InfluenzaA__AFD63727__NA

SEQ ID NO: 24130 - RNA, 1410 nt, Artificial Sequence; identical to SEQ ID NO: 16627
  derived and/or modified CDS sequence (AUadapt) from InfluenzaA__AFD63738__NA

SEQ ID NO: 24131 - RNA, 1410 nt, Artificial Sequence
  derived and/or modified CDS sequence (AUadapt) from InfluenzaA__AFD63749__NA
augaaccccaaccagaagaucaucaccaucucguccgugucgcugaccaucgccacgaucugcuuccucaugcagaucgccauccuggucaccaccgugacccugcacuucaagcagcacgagugcaacuccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaacaucaccggcuucgcccccuucuccaaggacaacucgauccgccucuccgccgggggcgacaucugggugacccgggagcccuacgugagcugcgaccccgacaagugcuaccaguucgcccuggggcagggcaccacgcugaacaacgggcacuccaacgacaccguccacgaccgcaccccguaccggacccuccugaugaacgagcugggcgugcccuuccaccucggcacgcgccaggugugcaucgccuggucguccagcuccugccacgacgggaaggcguggcugcacgucugcgugaccggcgacgacaagaacgccaccgccucguucaucuacaacgggcggcugguggacuccaucggcagcugguccaagaagauccuccgcacccaggagucggagugcgucugcaucaacgggacgugcaccguggugaugaccgacggcuccgccagcggcaaggcggacaccaagauccuguucaucgaggaggggaagaucguccacaucucgacgcuguccggcucggcccagcacguggaggagugcuccugcuacccccgguaccccggggugcgcugcgucugccgggacaacuggaagggcagcaaccgcccgaucguggacaucaacgugaaggacuacuccaucgucucguccuacgugugcagcggccucgugggggacacgccccggaagaacgacuccuucucguccagccacugccuggaccccaacaacgaggagggcgggcacggcgucaaggggugggccuucgacgacggcaacgacguguggaugggccgcaccaucuccgagaagcugcggucgggguacgagaccuucaaggucaucgagggcugguccaagcccaacagcaagcuccagaucaaccgccaggugaucguggagcgggggaaccgcuccggcuacucggggaucuucuccgucgagggcaagagcugcaucaaccggugcuucuacguggagcugauccgcggccggaaggaggagaccgaggugugguggaccucgaacuccaucgucguguucugcgggaccagcggcaccuacgggacgggcuccuggccggacggggccgacaucaaccugaugcccaucuga

SEQ ID NO: 24132 - RNA, 1410 nt, Artificial Sequence
  derived and/or modified CDS sequence (AUadapt) from InfluenzaA__AFD63760__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucauccacaucucgacgcugagcggguccgcccagcacgucgaggagugcucgugcuacccccgguaccccggcgugcgcugcgugugccgggacaacuggaagggcuccaaccgcccgaucgucgacaucaacgugaaggacuacucgaucguguccagcuacgucugcuccgggcucgugggcgacacgccccggaagaacgacucguccagcuccucgcacugccuggaccccaacaacgaggagggcgggcacggggugaagggcugggccuucgacgacggcaacgacgucuggauggggcgcaccaucuccgagaagcugcggucgggcuacgagaccuucaaggugaucgaggggugguccaagcccaacagcaagcuccagaucaaccgccaggucaucguggagcggggcaaccgcuccggguacucgggcaucuucuccguggagggcaagagcugcaucaaccggugcuucuacgucgagcugauccgcgggcggaaggaggagaccgaggugugguggaccucgaacuccaucguggucuucugcggcaccagcgggaccuacggcacgggguccuggccggacggcgccgacaucaaccugaugcccaucuga

SEQ ID NO: 24133 - RNA, 1410 nt, Artificial Sequence; identical to SEQ ID NO: 16627
  derived and/or modified CDS sequence (AUadapt) from InfluenzaA__AFD63771__NA

SEQ ID NO: 24134 - RNA, 1410 nt, Artificial Sequence; identical to SEQ ID NO: 16627
  derived and/or modified CDS sequence (AUadapt) from InfluenzaA__AFD63782__NA

SEQ ID NO: 24135 - RNA, 1410 nt, Artificial Sequence; identical to SEQ ID NO: 24132
  derived and/or modified CDS sequence (AUadapt) from InfluenzaA__AFD63793__NA

SEQ ID NO: 24136 - RNA, 1410 nt, Artificial Sequence; identical to SEQ ID NO: 16627
  derived and/or modified CDS sequence (AUadapt) from InfluenzaA__AFD63804__NA

SEQ ID NO: 24137 - RNA, 1410 nt, Artificial Sequence; identical to SEQ ID NO: 16627
  derived and/or modified CDS sequence (AUadapt) from InfluenzaA__AFD63815__NA

SEQ ID NO: 24138 - RNA, 1410 nt, Artificial Sequence; identical to SEQ ID NO: 16627
  derived and/or modified CDS sequence (AUadapt) from InfluenzaA__AFD63826__NA

SEQ ID NO: 24139 - RNA, 1410 nt, Artificial Sequence; identical to SEQ ID NO: 24132
  derived and/or modified CDS sequence (AUadapt) from InfluenzaA__AFD63837__NA

SEQ ID NO: 24140 - RNA, 1410 nt, Artificial Sequence
  derived and/or modified CDS sequence (AUadapt) from InfluenzaA__AFD63848__NA
augaaccccaaccagaagaucaucaccaucggcucggugucccugaccaucgccgccaucugcuuccucaugcagaucgcgauccuggucacgaccgugacccugcacuucaagcagcgcgagugcaacucgccgcccaacaaccaggugaugcucugcgagcccaccaucaucgagcggaacaucacggagaucgucuaccugaccaacaccaccaucgagaaggagaucugccccaagcuggccgaguaccgcaacugguccaagccgcagugcaacaucacgggguucgcccccuucagcaaggacaacuccauccggcucucggccggcggggacaucugggugacccgcgagcccuacguguccugcgaccccgacaagugcuaccaguucgcccugggccaggggaccacccugaacaacggccacagcaacgacacgguccacgaccggaccccguaccgcacccuccugaugaacgagcugggcgugcccuuccaccucgggacccgccaggugugcaucgcgugguccucguccucgugccacgacggcaaggccuggcugcacgucugcgugacgggggacgacaagaacgccaccgccuccuucaucuacaacggccggcugguggacagcaucggguccuggucgaagaagauccuccggacccaggaguccgagugcgucugcaucaacgggaccugcacgguggugaugaccgacggcagcgcguccgggaaggccgacaccaagauccuguucaucgaggagggcaagaucguccacaucucgacccugagcggguccgcccagcacguggaggagugcucgugcuacccccgcuaccccggcgugcggugcgucugccgcgacaacuggaagggcuccaaccggccgaucguggacaucaacgugaaggacuacucgaucgucuccagcuacgugugcuccgggcucgugggcgacacgccccgcaagaacgacucguucuccagcucccacugccuggaccccaacaacgaggagggcggccacggggucaagggcugggccuucgacgacggcaacgacguguggauggggcggaccaucucggagaagcugcgcuccggcuacgagaccuucaaggucaucgagggguggucgaagcccaacuccaagcuccagaucaaccgccaggugaucguggagcggggcaaccggagcggguacuccggcaucuucucggucgagggcaaguccugcaucaaccgcugcuucuacguggagcugauccgggggcgcaaggagaagaccgaggugugguggacgagcaacucgaucgucguguucugcggcaccuccgggaccuacggcaccgggagcuggccggacggcgccgacaucaaccugaugcccaucuga

SEQ ID NO: 24141 - RNA, 1410 nt, Artificial Sequence; identical to SEQ ID NO: 16547
  derived and/or modified CDS sequence (AUadapt) from InfluenzaA__AFD63859__NA

SEQ ID NO: 24142 - RNA, 1410 nt, Artificial Sequence; identical to SEQ ID NO: 16547
  derived and/or modified CDS sequence (AUadapt) from InfluenzaA__AFD63870__NA

SEQ ID NO: 24143 - RNA, 1410 nt, Artificial Sequence; identical to SEQ ID NO: 16627
  derived and/or modified CDS sequence (AUadapt) from InfluenzaA__AFD63881__NA

SEQ ID NO: 24144 - RNA, 1410 nt, Artificial Sequence; identical to SEQ ID NO: 16627
  derived and/or modified CDS sequence (AUadapt) from InfluenzaA__AFD63892__NA

SEQ ID NO: 24145 - RNA, 1410 nt, Artificial Sequence
  derived and/or modified CDS sequence (AUadapt) from InfluenzaA__AFD63903__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggggaucgucuaccugaccaacaccaccaucgagaaggagaucugccccaagcuggccgaguaccggaacugguccaagccgcagugcaacaucacgggcuucgcccccuucagcaaggacaacuccauccgccucucggccgggggcgacaucugggugacccgggagcccuacguguccugcgaccccgacaagugcuaccaguucgcccuggggcagggcaccacccugaacaacggccacagcaacgacacgguccacgaccgcaccccguaccggacccuccugaugaacgagcugggggugcccuuccaccucggcacccgccaggugugcaucgcgugguccucguccucgugccacgacgggaaggccuggcugcacgucugcgugacgggcgacgacaagaacgccaccgccuccuucaucuacaacgggcggcugguggacagcaucggcuccuggucgaagaagauccuccgcacccaggaguccgagugcgucugcaucaacgggaccugcacgguggugaugaccgacggcagcgcguccggcaaggccgacaccaagauccuguucaucgaggaggggaagaucguccacaucucgacccugagcggcuccgcccagcacguggaggagugcucgugcuacccccgguaccccggcgugcgcugcgucugccgggacaacuggaagggguccaaccgcccgaucguggacaucaacgugaaggacuacucgaucgucuccagcuacgugugcuccggccucgugggggacacgccccggaagaacgacucguucuccagcucccacugccuggaccccaacaacgaggagggcgggcacggcgucaagggcugggccuucgacgacgggaacgacguguggaugggccgcaccaucucggagaagcugcgguccggguacgagaccuucaaggucaucgagggcuggucgaagcccaacuccaagcuccagaucaaccgccaggugaucguggagcgggggaaccgcagcggcuacuccggcaucuucucggucgaggggaaguccugcaucaaccggugcuucuacguggagcugauccgcggccggaaggaggagaccgaggugugguggacgagcaacucgaucgucguguucugcgggaccuccggcaccuacgggaccggcagcuggccggacggcgccgacaucaaccugaugcccaucuga

SEQ ID NO: 24146 - RNA, 1410 nt, Artificial Sequence
  derived and/or modified CDS sequence (AUadapt) from InfluenzaA__AFD63914__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccucgugccacgacggcaaggccuggcugcacgucugcgugacgggggacgacaagaacgccaccgccuccuucaucuacaacggccggcugguggacagcaucggguccuggucgaagaagauccuccgcacccaggaguccgagugcgucugcaucaacgggaccugcacgguggugaugaccgacggcagcgcguccgggaaggccgacaccaagauccuguucaucgaggagggcaagaucguccacaucucgacccugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcggccacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggagaagaccgaggugugguggacgagcaacucgaucgucguguucugcggcaccuccgggaccuacggcaccgggagcuggccggacggcgccgacaucaaccugaugcccaucuga

SEQ ID NO: 24147 - RNA, 1410 nt, Artificial Sequence; identical to SEQ ID NO: 24132
  derived and/or modified CDS sequence (AUadapt) from InfluenzaA__AFD63925__NA

SEQ ID NO: 24148 - RNA, 1410 nt, Artificial Sequence
  derived and/or modified CDS sequence (AUadapt) from InfluenzaA__AFD63936__NA
augaaccccaaccagaagaucaucaccaucggcucggugucccugaccaucgccacgaucugcuuccucaugcagaucgccauccuggucaccaccgugacccugcacuucaagcagcacgagugcaacccgccgcccaacaaccaggugaugcucugcgagcccacgaucaucgagcgcaacaucaccgagaucgucuaccugaccaacaccacgaucgagaaggagaucugccccaagcuggcggaguaccggaacuggucgaagccccagugcaacaucaccggguucgcccccuucuccaaggacaacagcauccgccucuccgccggcggggacaucugggugacccgggagcccuacgugucgugcgacccggacaagugcuaccaguucgcccugggccaggggaccacgcugaacaacggccacuccaacgacaccguccacgaccgcacccccuaccggacccuccugaugaacgagcugggcgugcccuuccaccucgggacgcgccaggugugcaucgccuggucguccagcuccugccacgacggcaaggcguggcugcacgucugcgugaccggggacgacaagaacgccaccgccucguucaucuacaacggccggcugguggacuccaucgggagcugguccaagaagauccuccgcacccaggagucggagugcgucugcaucaacggcacgugcaccguggugaugaccgacggcuccgccucggggaaggcggacaccaagauccuguucaucgaggagggcaagaucguccacaucuccacgcugagcgggucggcccagcacguggaggagugcuccugcuacccccgguacccgggcgugcgcugcgucugccgggacaacuggaagggcagcaaccgccccaucguggacaucaacgugaaggacuacuccaucgucucguccuacgugugcucggggcucgugggcgacacgccccggaagaacgacuccuucagcuccucgcacugccuggaccccaacaacgaggagggcgggcacggggucaagggcugggccuucgacgacggcaacgacguguggauggggcgcaccaucuccgagaagcugcggagcggcuacgagaccuucaaggucaucgaggggugguccaagccgaacucgaagcuccagaucaaccgccaggugaucguggagcggggcaaccgcuccggguacucgggcaucuucuccgucgagggcaagagcugcaucaaccggugcuucuacguggagcugauccgcgggcggaaggaggagaccgaggugugguggaccuccaacucgaucgucguguucugcggcaccagcgggaccuacggcacgggguccuggcccgacggcgccgacaucaaccugaugcccaucuga

SEQ ID NO: 24149 - RNA, 1410 nt, Artificial Sequence; identical to SEQ ID NO: 16627
  derived and/or modified CDS sequence (AUadapt) from InfluenzaA__AFD63947__NA

SEQ ID NO: 24150 - RNA, 1410 nt, Artificial Sequence; identical to SEQ ID NO: 16627
  derived and/or modified CDS sequence (AUadapt) from InfluenzaA__AFD63958__NA

SEQ ID NO: 24151 - RNA, 1410 nt, Artificial Sequence; identical to SEQ ID NO: 16627
  derived and/or modified CDS sequence (AUadapt) from InfluenzaA__AFD63969__NA

SEQ ID NO: 24152 - RNA, 1410 nt, Artificial Sequence; identical to SEQ ID NO: 16627
  derived and/or modified CDS sequence (AUadapt) from InfluenzaA__AFD63980__NA

SEQ ID NO: 24153 - RNA, 1410 nt, Artificial Sequence
  derived and/or modified CDS sequence (AUadapt) from InfluenzaA__AFD64002__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccucgugccacgacggcaaggccuggcugcacgucugcgugacgggggacgacaagaacgccaccgccuccuucaucuacaacggccggcugguggacagcaucggguccuggucgaagaagauccuccgcacccaggaguccgagugcgucugcaucaacgggaccugcacgguggugaugaccgacggcagcgcguccgggaaggccgacaccaagauccuguucaucgaggagggcaagaucguccacaucucgacccugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaccgacucguucuccagcucccacugccuggaccccaacaacgaggagggcggccacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagacggaggugugguggaccagcaacucgaucgucguguucugcggcaccuccgggaccuacggcacggggagcuggccggacggcgccgacaucaaccugaugcccaucuga

SEQ ID NO: 24154 - RNA, 1410 nt, Artificial Sequence; identical to SEQ ID NO: 16537
  derived and/or modified CDS sequence (AUadapt) from InfluenzaA__AFD64013__NA

SEQ ID NO: 24155 - RNA, 1410 nt, Artificial Sequence
  derived and/or modified CDS sequence (AUadapt) from InfluenzaA__AFD64024__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagaagaacaucacggagaucgucuaccugaccaacaccaccaucgagaaggagaucugccccaagcuggccgaguaccgcaacugguccaagccgcagugcaacaucacgggguucgcccccuucagcaaggacaacuccauccggcucucggccggcggggacaucugggugacccgcgagcccuacguguccugcgaccccgacaagugcuaccaguucgcccugggccaggggaccacccugaacaacggccacagcaacgacacgguccacgaccggaccccguaccgcacccuccugaugaacgagcugggcgugcccuuccaccucgggacccgccaggugugcaucgcgugguccucguccucgugccacgacggcaaggccuggcugcacgucugcgugacgggggacgacaagaacgccaccgccuccuucaucuacaacggccggcugguggacagcaucggguccuggucgaagaagauccuccggacccaggaguccgagugcgucugcaucaacgggaccugcacgguggugaugaccgacggcagcgcguccgggaaggccgacaccaagauccuguucaucgaggagggcaagaucguccacaucucgacccugagcggguccgcccagcacguggaggagugcucgugcuacccccgcuaccccggcgugcggugcgucugccgcgacaacuggaagggcuccaaccggccgaucguggacaucaacgugaaggacuacucgaucgucuccagcuacgugugcuccgggcucgugggcgacacgccccgcaagaacgacucguucuccagcucccacugccuggaccccaacaacgaggagggcggccacggggucaagggcugggccuucgacgacggcaacgacguguggauggggcggaccaucucggagaagcugcgcuccggcuacgagaccuucaaggucaucgagggguggucgaagcccaacuccaagcuccagaucaaccgccaggugaucguggagcggggcaaccggagcggguacuccggcaucuucucggucgagggcaaguccugcaucaaccgcugcuucuacguggagcugauccgggggcgcaaggaggagaccgaggugugguggacgagcaacucgaucgucguguucugcggcaccuccgggaccuacggcaccgggagcuggccggacggcgccgacaucaaccugaugcccaucuga

SEQ ID NO: 24156 - RNA, 1410 nt, Artificial Sequence
  derived and/or modified CDS sequence (AUadapt) from InfluenzaA__AFD64035__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccucgugccacgacggcaaggccuggcugcacgucugcgugacgggggacgacaagaacgccaccgccuccuucaucuacaacggccggcugguggacagcaucggguccuggucgaagaagauccuccgcacccaggaguccgagugcgucugcaucaacgggaccugcacgguggugaugaccgacggcagcgcguccgggaaggccgacaccaagauccuguucaucgaggagggcaagaucguccacaucucgacccugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcggccacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggacgagcaacucggucgugguguucugcggcaccuccgggaccuacggcaccgggagcuggccggacggcgccgacaucaaccugaugcccaucuga

SEQ ID NO: 24157 - RNA, 1410 nt, Artificial Sequence
  derived and/or modified CDS sequence (AUadapt) from InfluenzaA__AFD64046__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgagcgcaccccguaccggacccuccugaugaacgagcugggcgugcccuuccaccucgggacgcgccaggugugcaucgccugguccucguccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcacggggagcuggccggacggcgccgacaucaaccugaugcccaucuga

SEQ ID NO: 24158 - RNA, 1410 nt, Artificial Sequence; identical to SEQ ID NO: 24132
  derived and/or modified CDS sequence (AUadapt) from InfluenzaA__AFD64057__NA

SEQ ID NO: 24159 - RNA, 1410 nt, Artificial Sequence
  derived and/or modified CDS sequence (AUadapt) from InfluenzaA__AFD64068__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacaaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagucccgcagcggcuacgagaccuucaaggucaucgaggggugguccaaccccaacucgaagcugcagaucaaccgccaggugaucguggaccggggcaaccgguccggguacagcggcaucuucucggucgaggggaaguccugcaucaaccgcugcuucuacguggagcugauccggggccgcaaggaggagaccgaggugcucuggaccagcaacuccaucgucguguucugcggcaccagcgggacguacggcaccggguccuggccggacggcgccgacaucaaccugaugcccaucuga

SEQ ID NO: 24160 - RNA, 1410 nt, Artificial Sequence
  derived and/or modified CDS sequence (AUadapt) from InfluenzaA__AFD64079__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgcaucucggccggcggggacaucugggugacccgggagcccuacguguccugcgaccccgacaagugcuaccaguucgcccucggccaggggaccacccugaacaacggccacagcaacgacacgguccacgaccgcaccccguaccggacccugcucaugaacgagcugggcgugcccuuccaccuggggacccgccaggugugcaucgcgugguccucguccucgugccacgacggcaaggccuggcuccacgucugcgugacgggggacgacaagaacgccaccgccuccuucaucuacaacggccggcugguggacagcaucggguccuggucgaagaagauccugcgcacccaggaguccgagugcgucugcaucaacgggaccugcacgguggugaugaccgacggcagcgcguccgggaaggccgacaccaagauccucuucaucgaggagggcaagaucguccacaucucgacccugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcuggugggcgacacgccccggaagaacgacucguucuccagcucccacugccucgaccccaacaacgaggagggcggccacggggucaagggcugggccuucgacgacggcaacgacguguggauggggcgcaccaucucggagaagcugcgguccggcuacgagaccuucaaggucaucgagggguggucgaagcccaacuccaagcugcagaucaaccgccaggugaucguggagcggggcaaccgcagcggguacuccggcaucuucucggucgagggcaaguccugcaucaaccggugcuucuacguggagcucauccgcgggcggaaggaggagaccgaggugugguggacgagcaacucgaucgucguguucugcggcaccuccgggaccuacggcaccgggagcuggccggacggcgccgacaucaaccugaugcccaucuga

SEQ ID NO: 24161 - RNA, 1410 nt, Artificial Sequence; identical to SEQ ID NO: 16627
  derived and/or modified CDS sequence (AUadapt) from InfluenzaA__AFD64090__NA

SEQ ID NO: 24162 - RNA, 1410 nt, Artificial Sequence
  derived and/or modified CDS sequence (AUadapt) from InfluenzaA__AFD64101__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacggccgcaccccguaccggacccuccugaugaacgagcugggggugcccuuccaccucggcacccgccaggugugcaucgcgugguccucguccucgugccacgacgggaaggccuggcugcacgucugcgugacgggcgacgacaagaacgccaccgccuccuucaucuacaacgggcggcugguggacagcaucggcuccuggucgaagaagauccuccgcacccaggaguccgagugcgucugcaucaacgggaccugcacgguggugaugaccgacggcagcgcguccggcaaggccgacaccaagauccuguucaucgaggaggggaagaucguccacaucucgacccugagcggcuccgcccagcacguggaggagugcucgugcuacccccgguaccccggcgugcgcugcgucugccgggacaacuggaagggguccaaccgcccgaucguggacaucaacgugaaggacuacucgaucgucuccagcuacgugugcuccggccucgugggggacacgccccggaagaacgacucguucuccagcucccacugccuggaccccaacaacgaggagggcgggcacggcgucaagggcugggccuucgacgacgggaacgacguguggaugggccgcaccaucucggagaagcugcgguccggguacgagaccuucaaggucaucgagggcuggucgaagcccaacuccaagcuccagaucaaccgccaggugaucguggagcgggggaaccgcagcggcuacuccggcaucuucucggucgaggggaaguccugcaucaaccggugcuucuacguggagcugauccgcggccggaaggaggagaccgaggugugguggacgagcaacucgaucgucguguucugcgggaccuccggcaccuacgggaccggcagcuggccggacggcgccgacaucaaccugaugcccaucuga

SEQ ID NO: 24163 - RNA, 1410 nt, Artificial Sequence
  derived and/or modified CDS sequence (AUadapt) from InfluenzaA__AFD64112__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucauccacaucucgacgcugagcggguccgcccagcacgucgaggagugcucgugcuacccccgguaccccggcgugcgcugcgugugccgggacaacuggaagggcuccaaccgcccgaucgucgacaucaacgugaaggacuacucgaucguguccagcuacgucugcuccgggcucgugggcgacacgccccggaagaacgacucguccagcuccucgcacugccuggaccccaacaacgaggagggcgggcacggggugaagggcugggccuucgacgacggcaacgacgucuggauggggcgcaccaucuccgagaagcugcggucgggcuacgagaccuucaaggugaucgaggggugguccaagcccaacagcaagcuccagaucaaccgccaggucaucguggagcgggacaaccgcuccggcuacucggggaucuucuccguggagggcaagagcugcaucaaccggugcuucuacgucgagcugauccgcggccggaaggaggagaccgaggugugguggaccucgaacuccaucguggucuucugcgggaccagcggcaccuacgggacgggcuccuggccggacggggccgacaucaaccugaugcccaucuga

SEQ ID NO: 24164 - RNA, 1410 nt, Artificial Sequence; identical to SEQ ID NO: 18333
  derived and/or modified CDS sequence (AUadapt) from InfluenzaA__AFD64123__NA

SEQ ID NO: 24165 - RNA, 1410 nt, Artificial Sequence; identical to SEQ ID NO: 16627
  derived and/or modified CDS sequence (AUadapt) from InfluenzaA__AFD64134__NA

SEQ ID NO: 24166 - RNA, 1410 nt, Artificial Sequence; identical to SEQ ID NO: 16627
  derived and/or modified CDS sequence (AUadapt) from InfluenzaA__AFD64145__NA

SEQ ID NO: 24167 - RNA, 1410 nt, Artificial Sequence; identical to SEQ ID NO: 16627
  derived and/or modified CDS sequence (AUadapt) from InfluenzaA__AFD64156__NA

SEQ ID NO: 24168 - RNA, 1410 nt, Artificial Sequence; identical to SEQ ID NO: 16547
  derived and/or modified CDS sequence (AUadapt) from InfluenzaA__AFD64167__NA

SEQ ID NO: 24169 - RNA, 1410 nt, Artificial Sequence; identical to SEQ ID NO: 16627
  derived and/or modified CDS sequence (AUadapt) from InfluenzaA__AFD64181__NA

SEQ ID NO: 24170 - RNA, 1410 nt, Artificial Sequence
  derived and/or modified CDS sequence (AUadapt) from InfluenzaA__AFD64192__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccucgugccacgacggcaaggccuggcugcacgucugcgugacgggggacgacaagaacgccaccgccuccuucaucuacaacggccggcugguggacagcaucggguccuggucgaagaagauccuccgcacccaggaguccgagugcgucugcaucaacgggaccugcacgguggugaugaccgacggcagcgcguccgggaaggccgacaccaagauccuguucaucgaggagggcaagaucguccacgugucgacccugagcggguccgcccagcacguggaggagugcucgugcuacccccgguaccccggcguccgcugcgugugccgggacaacuggaagggcuccaaccgcccgaucguggacaucaacgucaaggacuacucgaucguguccagcuacgugugcuccgggcucgucggcgacacgccccggaagaacgacucguucuccagcucccacugccuggaccccaacaacgaggagggcggccacggggugaagggcugggccuucgacgacggcaacgacgucuggauggggcgcaccaucucggagaagcugcgguccggcuacgagaccuucaaggugaucgagggguggucgaagcccaacuccaagcuccagaucaaccgccaggugaucgucgagcggggcaaccgcagcggguacuccggcaucuucucgguggagggcaaguccugcaucaaccggugcuucuacguggagcugauccgcgggcggaaggaggagaccgaggucugguggacgagcaacucgaucgugguguucugcggcaccuccgggaccuacggcaccgggagcuggccggacggcgccgacaucaaccugaugcccaucuga

SEQ ID NO: 24171 - RNA, 1410 nt, Artificial Sequence
  derived and/or modified CDS sequence (AUadapt) from InfluenzaA__AFD64203__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaaccgccacagcaacgacacgguccacgaccggaccccguaccgcacccuccugaugaacgagcugggcgugcccuuccaccucggcacccgccaggugugcaucgcgugguccucguccucgugccacgacgggaaggccuggcugcacgucugcgugacgggcgacgacaagaacgccaccgccuccuucaucuacaacgggcggcugguggacagcaucggcuccuggucgaagaagauccuccggacccaggaguccgagugcgucugcaucaacgggaccugcacgguggugaugaccgacggcagcgcguccggcaaggccgacaccaagauccuguucaucgaggaggggaagaucguccacaucucgacccugagcggcuccgcccagcacguggaggagugcucgugcuacccccgcuaccccggggugcggugcgucugccgcgacaacuggaagggcuccaaccggccgaucguggacaucaacgugaaggacuacucgaucgucuccagcuacgugugcuccggccucgugggggacacgccccgcaagaacgacucguucuccagcucccacugccuggaccccaacaacgaggagggcgggcacggcgucaaggggugggccuucgacgacggcaacgacguguggaugggccggacccugucggagaagcuccgcuccggguacgagaccuucaaggucaucgagggcuggucgaagcccaacuccaagcugcagaucaaccgccaggugaucguggagcgggggaaccggagcggcuacuccgggaucuucucggucgagggcaaguccugcaucaaccgcugcuucuacguggagcugauccggggccgcaaggaggagaccgaggugugguggacgagcaacucgaucgucguguucugcgggaccuccggcaccuacgggaccggcagcuggccggacggggccgacaucaaccucaugcccaucuga

SEQ ID NO: 24172 - RNA, 1410 nt, Artificial Sequence; identical to SEQ ID NO: 24132
  derived and/or modified CDS sequence (AUadapt) from InfluenzaA__AFD64214__NA

SEQ ID NO: 24173 - RNA, 1410 nt, Artificial Sequence; identical to SEQ ID NO: 18331
  derived and/or modified CDS sequence (AUadapt) from InfluenzaA__AFD64225__NA

SEQ ID NO: 24174 - RNA, 1410 nt, Artificial Sequence; identical to SEQ ID NO: 16627
  derived and/or modified CDS sequence (AUadapt) from InfluenzaA__AFD64317__NA

SEQ ID NO: 24175 - RNA, 1410 nt, Artificial Sequence; identical to SEQ ID NO: 18333
  derived and/or modified CDS sequence (AUadapt) from InfluenzaA__AFD64328__NA

SEQ ID NO: 24176 - RNA, 1410 nt, Artificial Sequence; identical to SEQ ID NO: 24132
  derived and/or modified CDS sequence (AUadapt) from InfluenzaA__AFD64339__NA

SEQ ID NO: 24177 - RNA, 1410 nt, Artificial Sequence; identical to SEQ ID NO: 16627
  derived and/or modified CDS sequence (AUadapt) from InfluenzaA__AFD64350__NA

SEQ ID NO: 24178 - RNA, 1410 nt, Artificial Sequence; identical to SEQ ID NO: 24132
  derived and/or modified CDS sequence (AUadapt) from InfluenzaA__AFD64361__NA

SEQ ID NO: 24179 - RNA, 1410 nt, Artificial Sequence; identical to SEQ ID NO: 24132
  derived and/or modified CDS sequence (AUadapt) from InfluenzaA__AFD64372__NA

SEQ ID NO: 24180 - RNA, 1410 nt, Artificial Sequence; identical to SEQ ID NO: 16627
  derived and/or modified CDS sequence (AUadapt) from InfluenzaA__AFD64383__NA

SEQ ID NO: 24181 - RNA, 1410 nt, Artificial Sequence; identical to SEQ ID NO: 24132
  derived and/or modified CDS sequence (AUadapt) from InfluenzaA__AFD64394__NA

SEQ ID NO: 24182 - RNA, 1410 nt, Artificial Sequence; identical to SEQ ID NO: 16627
  derived and/or modified CDS sequence (AUadapt) from InfluenzaA__AFD64405__NA

SEQ ID NO: 24183 - RNA, 1410 nt, Artificial Sequence; identical to SEQ ID NO: 16627
  derived and/or modified CDS sequence (AUadapt) from InfluenzaA__AFD64416__NA

SEQ ID NO: 24184 - RNA, 1410 nt, Artificial Sequence; identical to SEQ ID NO: 16627
  derived and/or modified CDS sequence (AUadapt) from InfluenzaA__AFD64427__NA

SEQ ID NO: 24185 - RNA, 1410 nt, Artificial Sequence
  derived and/or modified CDS sequence (AUadapt) from InfluenzaA__AFD64438__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaaccuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccucgugccacgacggcaaggccuggcugcacgucugcgugacgggggacgacaagaacgccaccgccuccuucaucuacaacggccggcugguggacagcaucggguccuggucgaagaagauccuccgcacccaggaguccgagugcgucugcaucaacgggaccugcacgguggugaugaccgacggcagcgcguccgggaaggccgacaccaagauccuguucaucgaggagggcaagaucguccacaucucgacccugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcggccacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggacgagcaacucgaucgucguguucugcggcaccuccgggaccuacggcaccgggagcuggccggacggcgccgacaucaaccugaugcccaucuga

SEQ ID NO: 24186 - RNA, 1410 nt, Artificial Sequence; identical to SEQ ID NO: 16627
  derived and/or modified CDS sequence (AUadapt) from InfluenzaA__AFD64449__NA

SEQ ID NO: 24187 - RNA, 1410 nt, Artificial Sequence; identical to SEQ ID NO: 16547
  derived and/or modified CDS sequence (AUadapt) from InfluenzaA__AFD64460__NA

SEQ ID NO: 24188 - RNA, 1410 nt, Artificial Sequence; identical to SEQ ID NO: 23545
  derived and/or modified CDS sequence (AUadapt) from InfluenzaA__AFD98098__NA

SEQ ID NO: 24189 - RNA, 1410 nt, Artificial Sequence
  derived and/or modified CDS sequence (AUadapt) from InfluenzaA__AFD98120__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggacaagggcaaccgguccggguacucgggcaucuucuccgucgagggcaagagcugcaucaaccgcugcuucuacguggagcucauccgggggcgcaaggaggagaccgaggugcuguggaccucgaacuccaucgucguguucugcggcacgagcgggaccuacggcaccggguccuggccggacggcgccgaccugaaccucaugcccaucuga

SEQ ID NO: 24190 - RNA, 1410 nt, Artificial Sequence; identical to SEQ ID NO: 21920
  derived and/or modified CDS sequence (AUadapt) from InfluenzaA__AFD98131__NA

SEQ ID NO: 24191 - RNA, 1410 nt, Artificial Sequence; identical to SEQ ID NO: 23545
  derived and/or modified CDS sequence (AUadapt) from InfluenzaA__AFD98142__NA

SEQ ID NO: 24192 - RNA, 1410 nt, Artificial Sequence; identical to SEQ ID NO: 24189
  derived and/or modified CDS sequence (AUadapt) from InfluenzaA__AFD98164__NA

SEQ ID NO: 24193 - RNA, 1410 nt, Artificial Sequence
  derived and/or modified CDS sequence (AUadapt) from InfluenzaA__AFD98175__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccacgaccgcaccccguaccggacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcgccugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcugcagaucaaccgccaggugaucguggacaagggcaaccgguccggguacucgggcaucuucuccgucgagggcaagagcugcaucaaccggugcuucuacguggagcucauccgcgggcggaaggaggagaccgaggugcuguggaccucgaacuccaucgucguguucugcggcacgagcgggaccuacggcaccggguccuggccggacggcgccgaccugaaccucaugcccaucuga

SEQ ID NO: 24194 - RNA, 1410 nt, Artificial Sequence
  derived and/or modified CDS sequence (AUadapt) from InfluenzaA__AFD98186__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucguggaggagggcaagaucgugcacacgagcacccuguccgggucggcgcagcacgucgaggagugcuccugcuacccccgcuaccccggcgugcggugcgugugccgcgacaacuggaaggggagcaaccggccgaucgucgacaucaacaucaaggaccacuccaucaucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcugcagaucaaccgccaggugaucguggaccggggcaaccgguccggguacucgggcaucuucuccgucgagggcaagagcugcaucaaccgcugcuucuacguggagcucauccgggggcgcaaggaggagaccgaggugcuguggaccucgaacuccaucgucguguucugcggcacgagcgggaccuacggcaccggguccuggccggacggcgccgaccugaaccucaugcccaucuga

SEQ ID NO: 24195 - RNA, 1410 nt, Artificial Sequence; identical to SEQ ID NO: 21920
  derived and/or modified CDS sequence (AUadapt) from InfluenzaA__AFD98197__NA

SEQ ID NO: 24196 - RNA, 1410 nt, Artificial Sequence; identical to SEQ ID NO: 22657
  derived and/or modified CDS sequence (AUadapt) from InfluenzaA__AFD98208__NA

SEQ ID NO: 24197 - RNA, 1410 nt, Artificial Sequence
  derived and/or modified CDS sequence (AUadapt) from InfluenzaA__AFD98218__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccucguccugccacgacgggaaggccuggcugcacgugugcaucaccggcgacgacaagaacgcgaccgccagcuucaucuacaacgggcggcucguggacuccguggucucgugguccaaggagauccugcgcacccaggagagcgagugcgugugcaucaacggcacgugcaccguggucaugaccgacggguccgccucgggcaaggccgacaccaagauccuguucaucgaggagggcaagaucgugcacacgucgacccucuccgggagcgcgcagcacguggaggagugcuccugcuacccccgguacccgggcguccgcugcgugugccgggacaacuggaaggggucgaaccgccccaucguggacaucaacaucaaggaccacuccaucgucagcuccuacgugugcucgggccuggugggcgacaccccgcggaagaacgacuccucguccagcucccacugccuggaccccaacaacgaggagggcgggcacggggucaagggcugggccuucgacgacgggaacgacguguggaugggccgcaccaucgacgagacgucgcggcucggcuacgagaccuucaaggucaucgaggggugguccaaccccaagagcaagcugcagaucaaccgccaggugaucguggacaagggcaaccgguccggguacucgggcaucuucuccgucgagggcaagucgugcaucaaccgcugcuucuacguggagcugauccgggggcgcaaggaggagaccgaggugcucuggaccagcaacuccaucgucgugucgugcggcacguccgggaccuacggcaccgggagcuggcccgacggcgccgaccugaaccugaugcccaucuga

SEQ ID NO: 24198 - RNA, 1410 nt, Artificial Sequence; identical to SEQ ID NO: 21920
  derived and/or modified CDS sequence (AUadapt) from InfluenzaA__AFD98229__NA

SEQ ID NO: 24199 - RNA, 1410 nt, Artificial Sequence; identical to SEQ ID NO: 21920
  derived and/or modified CDS sequence (AUadapt) from InfluenzaA__AFD98240__NA

SEQ ID NO: 24200 - RNA, 1410 nt, Artificial Sequence; identical to SEQ ID NO: 24189
  derived and/or modified CDS sequence (AUadapt) from InfluenzaA__AFD98251__NA

SEQ ID NO: 24201 - RNA, 1410 nt, Artificial Sequence; identical to SEQ ID NO: 24189
  derived and/or modified CDS sequence (AUadapt) from InfluenzaA__AFD98262__NA

SEQ ID NO: 24202 - RNA, 1410 nt, Artificial Sequence; identical to SEQ ID NO: 23111
  derived and/or modified CDS sequence (AUadapt) from InfluenzaA__AFD98273__NA

SEQ ID NO: 24203 - RNA, 1410 nt, Artificial Sequence; identical to SEQ ID NO: 22659
  derived and/or modified CDS sequence (AUadapt) from InfluenzaA__AFD98283__NA

SEQ ID NO: 24204 - RNA, 1410 nt, Artificial Sequence; identical to SEQ ID NO: 21920
  derived and/or modified CDS sequence (AUadapt) from InfluenzaA__AFD98293__NA

SEQ ID NO: 24205 - RNA, 1410 nt, Artificial Sequence; identical to SEQ ID NO: 23111
  derived and/or modified CDS sequence (AUadapt) from InfluenzaA__AFD98313__NA

SEQ ID NO: 24206 - RNA, 1410 nt, Artificial Sequence; identical to SEQ ID NO: 22659
  derived and/or modified CDS sequence (AUadapt) from InfluenzaA__AFD98323__NA

SEQ ID NO: 24207 - RNA, 1410 nt, Artificial Sequence; identical to SEQ ID NO: 23111
  derived and/or modified CDS sequence (AUadapt) from InfluenzaA__AFD98333__NA

SEQ ID NO: 24208 - RNA, 1410 nt, Artificial Sequence; identical to SEQ ID NO: 24189
  derived and/or modified CDS sequence (AUadapt) from InfluenzaA__AFD98343__NA

SEQ ID NO: 24209 - RNA, 1410 nt, Artificial Sequence
  derived and/or modified CDS sequence (AUadapt) from InfluenzaA__AFD98354__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacccaggagucggagugcgugugcaucaacggcacgugcaccguggucaugaccgacgggaacgccuccggcaaggccgacaccaagauccucuucaucgaggagggcaagaucgugcacacgagcacccugcuggggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccucgugggcgacacgccccggaagaacgacuccucguccagcucccacugccuggaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcuccagaucaaccgccaggugaucguggacaagggcaaccgguccggguacucgggcaucuucuccgucgagggcaagagcugcaucaaccgcugcuucuacguggagcugauccgggggcgcaaggaggagaccgaggugcuguggaccuccaacucgaucgucguguucugcggcacgagcgggaccuacggcaccggguccuggccggacggcgccgaccucaaccugaugcccaucuga

SEQ ID NO: 24210 - RNA, 1410 nt, Artificial Sequence
  derived and/or modified CDS sequence (AUadapt) from InfluenzaA__AFD98365__NA
augaaccccaaccagaagaucaucaccaucggcucggugucccugaccaucagcacgaucugcuucuucaugcagaucgccauccucaucaccaccgucacccugcacuucaagcaguacgaguucuacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccucgucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagucgaagcugcagaucaaccgccaggugaucguggaccggggcaaccgcuccggguacagcggcaucuucuccgucgagggcaagucgugcaucaaccggugcuucuacguggagcucauccgcgggcggaaggaggagaccaaggugcuguggaccagcaacuccaucgucguguucugcggcacgagcgggaccuacggcaccggguccuggccggacggcgccgaccugaaccucaugcccaucuga

SEQ ID NO: 24211 - RNA, 1410 nt, Artificial Sequence
  derived and/or modified CDS sequence (AUadapt) from InfluenzaA__AFD98376__NA
augaaccccaaccagaagaucaucaccaucggcucggugucccugaccaucagcacgaucugcuucuucaugcagaucgccauccucaucaccaccgucacccugcacuucaagcaguacgaguucaacuucccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucucgaaggacaacuccauccgccugagcgccggcggggacaucugggucacccgggagcccuacguguccugcgaccccgacaagugcuaccaguucgcccucggccaggggaccacgcugaacaacgugcacucgaacaacaccguccgcgaccggaccccguaccgcacccugcucaugaacgagcugggcgugcccuuccaccugggcacgaagcaggucugcaucgccugguccagcuccucgugccacgacgggaaggccuggcuccacgugugcaucaccggcgacgacaagaacgcgaccgccuccuucaucuacaacgggcggcugguggacagcguggucuccuggucgaaggagauccugcgcacccaggaguccgagugcgugugcaucaacggcacgugcaccguggucaugaccgacgggagcgccuccggcaaggccgacaccaagauccucuucaucgaggagggcaagaucgugcacacgucgacccugagcggguccgcgcagcacguggaggagugcucgugcuacccccgguaccccggcguccgcugcgugugccgggacaacuggaagggguccaaccgcccgaucguggacaucaacaucaaggaccacagcaucgucuccucguacgugugcuccggccuggugggcgacacgccccggaagaacgacagcuccucguccgggcacugccucgaccccaacaacgaggagggcgggcacggcgucaaggggugggccuucgacgacggcaacgacguguggaugggccgcaccaucaacgagaccagccggcugggguacgagaccuucaaggucaucgagggcugguccaaccccaagucgaagcugcagaucaaccgccaggugaucguggacaaggggaaccgguccggcuacagcgggaucuucuccgucgagggcaagucgugcaucaaccgcugcuucuacguggagcucauccggggccgcaaggaggagaccgaggugcuguggaccuccaacagcaucgucguguucugcgggacgagcggcaccuacgggaccggcuccuggccggacggggccgaccugaaccucaugcccaucuga

SEQ ID NO: 24212 - RNA, 1410 nt, Artificial Sequence
  derived and/or modified CDS sequence (AUadapt) from InfluenzaA__AFD98387__NA
augaaccccaaccagaagaucaucaccaucggcucggugucccugaccaucucgacgaucugcuuccucaugcagaucgccauccugaucaccaccgucacccugcacuucaagcaguacgaguucaacuccccgcccaacaaccaggugaugcucugcgagcccacgaucaucgagcgcaacaucaccgagaucguguaccugaccaacaccacgaucgagaaggagaucugccccaagcuggccgaguaccgggacuggagcaagccgcagugcgacaucaccggguucgcgcccuucuccaaggacaacucgauccgccucuccgccggcggggacaucugggucacccgggagcccuacgugucgugcgaccccgacaagugcuaccaguucgcccugggccaggggaccacgcugaacaacgugcacuccaacaacaccguccgcgaccggaccccguaccgcacccuccugaugaacgagcugggcgugcccuuccaccucggcacgaagcaggucugcaucgccuggagcuccucguccugccacgacgggaaggccuggcugcacgugugcaucaccggcgacgacaagaacgcgaccgccagcuucaucuacaacgggaagcugguggacuccguggucucgugguccaaggagauccuccggacccaggagucggagugcgugugcaucaacggcacgugcaccguggucaugaccgacggguccgccagcggcaaggccgacaccaagauccuguucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggaccacuccaucgucucguccuacgugugcagcggccucgugggcgacacgccccgcaagaacgaccgguccucgaacucccacugccuggaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagucgaagcuccagaucaaccgccaggugaucguggaccggggcaaccgcuccggguacucgggcaucuucuccgucgagggcaagagcugcaucaaccggugcuucuacguggagcugauccgcgggcggaaggaggagaccgaggugcuguggaccuccaacucgaucgucguguucugcggcacgagcgggaccuacggcaccggguccuggccggacggcgccgaccucaaccugaugcccaucuga

SEQ ID NO: 24213 - RNA, 1410 nt, Artificial Sequence
  derived and/or modified CDS sequence (AUadapt) from InfluenzaA__AFD98398__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgcgccaggugugcaucgccuggagcuccucguccugccacgacgggaaggccuggcuccacgucugcaucaccggcgacgacaagaacgcgaccgccagcuucaucuacaacgggcggcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcugcagaucaaccgccaggugaucguggacaagggcaaccgguccggguacucgggcaucuucuccgucgagggcaagagcugcaucaaccggugcuucuacguggagcucauccgcgggcggaaggaggagaccgaggugcuguggaccucgaacuccaucgucguguucugcggcacgagcgggaccuacggcaccggguccuggccggacggcgccgaccugaaccucaugcccaucuga

SEQ ID NO: 24214 - RNA, 1410 nt, Artificial Sequence
  derived and/or modified CDS sequence (AUadapt) from InfluenzaA__AFD98409__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcgggcacugccucgaccccaacaacgaggagggcgggcacggcgucaaggggugggccuucgacgacggcaacgacguguggaugggccgcaccaucaacgagaccucccggcugggguacgagaccuucaaggucaucgagggcuggucgaaccccaaguccaagcugcagaucaaccgccaggugaucguggacaaggggaaccggagcggcuacuccgggaucuucucggucgagggcaaguccugcaucaaccgcugcuucuacguggagcucauccggggccgcaaggaggagaccgaggugcuguggaccagcaacucgaucgucguguucugcgggacguccggcaccuacgggaccggcagcuggccggacggggccgaccugaaccucaugcccaucuga

SEQ ID NO: 24215 - RNA, 1410 nt, Artificial Sequence; identical to SEQ ID NO: 24189
  derived and/or modified CDS sequence (AUadapt) from InfluenzaA__AFD98420__NA

SEQ ID NO: 24216 - RNA, 1410 nt, Artificial Sequence
  derived and/or modified CDS sequence (AUadapt) from InfluenzaA__AFD98431__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucgugggccgggggaaccgcuccggcuacucggggaucuucuccgucgagggcaagagcugcaucaaccggugcuucuacguggagcucauccgcggccggaaggaggagaccgaggugcuguggaccucgaacuccaucgucguguucugcgggacgagcggcaccuacgggaccggcuccuggccggacggggccgaccugaaccucaugcccaucuga

SEQ ID NO: 24217 - RNA, 1410 nt, Artificial Sequence
  derived and/or modified CDS sequence (AUadapt) from InfluenzaA__AFD98442__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagucggucguguccgugaagcuggccgggaacagcucccucugcccggucagcggcugggccaucuacuccaaggacaacagcauccgcaucggcuccaagggggacguguucgugauccgggagcccuucaucucgugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccucguacaagaucuuccgcaucgagaaggggaagaucgugaaguccgucgagaugaacgcccccaacuaccacuacgaggagugcagcugcuaccccgacuccggcgagaucacgugcgugugccgggacaacuggcacgggagcaaccgccccuggguguccuucaaccagaaccucgaguaccagaucggcuacaucugcagcgggaucuucggcgacaacccgcggcccaacgacaagaccggcuccugcgggcccgucucguccaacggcgccaacggggugaagggcuucagcuucaaguacgggaacggcguguggaucggccgcaccaaguccaucagcagccggaagggguucgagaugaucugggaccccaacggcuggaccgggaccgacaacaacuucgccaucaagcaggacaucgucggcaucaacgagugguccggguacucgggcuccuucgugcagcacccggagcugacgggccuggacugcauccgccccugcuucuggguggagcucauccgggggcgccccaaggagaacaccaucuggaccagcggcuccagcaucuccuucugcggggucaacagcgacaccgugggcugguccuggcccgacggcgcggagcugccguucacgaucgacaaguga

SEQ ID NO: 24218 - RNA, 1410 nt, Artificial Sequence
  derived and/or modified CDS sequence (AUadapt) from InfluenzaA__AFD98452__NA
augaaccccaaccagaagaucaucacccugggcucggugucccucaccaucagcacgaucugcuucuucauccagaucgccauccugaucaccaccgucacccugcacuucaagcaguacgaguucaacuccccgcccaacaaccaggugaugcucugcgagcccacgaucaucgagcgcaacaucaccgagaucguguaccugaccaacaccacgaucgagaaggagaucugccccaagcuggccgaguaccggaacuggucgaagccgcagugcgacaucaccggguucgcgcccuucuccaaggacaacagcauccgccucuccgccggcggggacaucugggucacccgggagcccuacgugucgugcgaccccgacaagugcuaccaguucgcccugggccaggggaccacgcugaacaacgugcacuccaacaacaccguccgcgaccggaccccguaccgcacccuccugaugaacgagcugggcgugcccuuccaccucggcacgaagcaggucugcaucgccuggagcuccucguccugccacgacgggaaggccuggcugcacgugugcaucaccggcgacgacaagaacgcgaccgccagcuucaucuacaacgggcggcugguggacuccguggucucgugguccaaggagauccuccgcacccaggagagcgagugcgugugcaucaacggcacgugcaccguggucaugaccgacggguccgccucgggcaaggccgacaccaagauccuguucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccucgugggcgacacgccccggaagaacgacuccucguccagcucccacugccuggaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcuccagaucaaccgccaggugaucguggaccggggcaaccgcuccggguacucgggcaucuucuccgucgagggcaagagcugcaucaaccggugcuucuacguggagcugauccgcgggcggaaggaggagaccgaggugcuguggaccucgaacuccaucgucguguucugcggcacgagcgggaccuacggcaccggguccuggccggacggcgccgaccucaaccugaugcccaucuga

SEQ ID NO: 24219 - RNA, 1410 nt, Artificial Sequence; identical to SEQ ID NO: 24189
  derived and/or modified CDS sequence (AUadapt) from InfluenzaA__AFD98463__NA

SEQ ID NO: 24220 - RNA, 1410 nt, Artificial Sequence
  derived and/or modified CDS sequence (AUadapt) from InfluenzaA__AFD98474__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucucgaucaagcaggacaucaucgggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 24221 - RNA, 1410 nt, Artificial Sequence
  derived and/or modified CDS sequence (AUadapt) from InfluenzaA__AFD98484__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaugaaccgccaggugaucguggaccggggcaaccgcuccggguacucgggcaucuucuccgucgagggcaagagcugcaucaaccggugcuucuacguggagcucauccgcgggcggaaggaggagaccgaggugcuguggaccucgaacuccaucgucguguucugcggcacgagcgggaccuacggcaccggguccuggccggacggcgccgaccugaaccucaugcccaucuga

SEQ ID NO: 24222 - RNA, 1410 nt, Artificial Sequence
  derived and/or modified CDS sequence (AUadapt) from InfluenzaA__AFD98495__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccaacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcugcagaucaaccgccaggugaucguggaccggggcaaccgguccggguacucgggcaucuucuccgucgagggcaagagcugcaucaaccgcugcuucuacguggagcucauccgggggcgcaaggaggagaccgaggugcuguggaccucgaacuccaucgucguguucugcggcacgagcgggaccuacggcaccggguccuggccggacggcgccgaccugaaccucaugcccaucuga

SEQ ID NO: 24223 - RNA, 1410 nt, Artificial Sequence; identical to SEQ ID NO: 24189
  derived and/or modified CDS sequence (AUadapt) from InfluenzaA__AFD98506__NA

SEQ ID NO: 24224 - RNA, 1410 nt, Artificial Sequence
  derived and/or modified CDS sequence (AUadapt) from InfluenzaA__AFD98517__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucaaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcugcagaucaaccgccaggugaucguggaccggggcaaccgguccggguacucgggcaucuucuccgucgagggcaagagcugcaucaaccgcugcuucuacguggagcucauccgggggcgcaaggaggagaccgaggugcuguggaccucgaacuccaucgucguguucugcggcacgagcgggaccuacggcaccggguccuggccggacggcgccgaccugaaccucaugcccaucuga

SEQ ID NO: 24225 - RNA, 1410 nt, Artificial Sequence; identical to SEQ ID NO: 21920
  derived and/or modified CDS sequence (AUadapt) from InfluenzaA__AFD98528__NA

SEQ ID NO: 24226 - RNA, 1410 nt, Artificial Sequence; identical to SEQ ID NO: 24189
  derived and/or modified CDS sequence (AUadapt) from InfluenzaA__AFD98539__NA

SEQ ID NO: 24227 - RNA, 1410 nt, Artificial Sequence; identical to SEQ ID NO: 24189
  derived and/or modified CDS sequence (AUadapt) from InfluenzaA__AFD98550__NA

SEQ ID NO: 24228 - RNA, 1410 nt, Artificial Sequence
  derived and/or modified CDS sequence (AUadapt) from InfluenzaA__AFD98561__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcgccguggucaugaccgacggguccgccucgggcaaggcggacaccaagauccucuucaucgaggagggcaagaucgugcacaccagcacgcuguccgggucggcccagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaaguccgacucguccagcuccucgcacugccucgaccccaacaacgaggagggcgggcacggggucaagggcugggccuucgacgacgggaacgacguguggaugggccgcaccaucaacgagaccucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgaccugaaccucaugcccaucuga

SEQ ID NO: 24229 - RNA, 1410 nt, Artificial Sequence
  derived and/or modified CDS sequence (AUadapt) from InfluenzaA__AFD98572__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgcuggagaaggagaucugccccaagcuggccgaguaccggaacuggucgaagccgcagugcgacaucaccggguucgcgcccuucuccaaggacaacagcauccgccucuccgccggcggggacaucugggucacccgggagcccuacgugucgugcgaccccgacaagugcuaccaguucgcccugggccaggggaccacgcugaacaacgugcacuccaacaacaccguccgcgaccggaccccguaccgcacccuccugaugaacgagcugggcgugcccuuccaccucggcacgaagcaggucugcaucgccuggagcuccucguccugccacgacgggaaggccuggcugcacgugugcaucaccggcgacgacaagaacgcgaccgccagcuucaucuacaacgggcggcugguggacuccguggucucgugguccaaggagauccuccgcacccaggagagcgagugcgugugcaucaacggcacgugcaccguggucaugaccgacggguccgccucgggcaaggccgacaccaagauccuguucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccucgugggcgacacgccccggaagaacgacuccucguccagcucccacugccuggaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcuccagaucaaccgccaggugaucguggaccggggcaaccgcuccggguacucgggcaucuucuccgucgagggcaagagcugcaucaaccggugcuucuacguggagcugauccgcgggcggaaggaggagaccgaggugcuguggaccucgaacuccaucgucguguucugcggcacgagcgggaccuacggcaccggguccuggccggacggcgccgaccucaaccugaugcccaucuga

SEQ ID NO: 24230 - RNA, 1410 nt, Artificial Sequence
  derived and/or modified CDS sequence (AUadapt) from InfluenzaA__AFD98583__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucucccgcgacaacagcauccggcuguccgccggcggggacaucugggucacccgcgagcccuacgugucgugcgaccccgacaagugcuaccaguucgcccucggccaggggaccacgcugaacaacgugcacuccaacaacaccguccgggaccgcaccccguaccggacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcgccugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaaguccgacucguccagcuccucgcacugccucgaccccaacaacgaggagggcgggcacggggucaagggcugggccuucgacgacgggaacgacguguggaugggccggaccaucaacgagaccucccgccugggcuacgagaccuucaaggucaucgagggguggagcaaccccaaguccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcacguccgggaccuacggcaccgggagcuggccggacggcgccgaccugaaccucaugcccaucuga

SEQ ID NO: 24231 - RNA, 1410 nt, Artificial Sequence
  derived and/or modified CDS sequence (AUadapt) from InfluenzaA__AFE02944__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccugaacugcauccgccccugcuucugggucgagcucauccggggccgccccaaggagaacaccguguggaccagcggguccagcaucuccuucugcggcgucaacagcgacaccguggggugguccuggcccgacggcgccgagcugccguucacgaucgacaaguga

SEQ ID NO: 24232 - RNA, 1410 nt, Artificial Sequence
  derived and/or modified CDS sequence (AUadapt) from InfluenzaA__AFE47627__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccucgugccacgacggcaaggcguggcugcacgugugcgugaccggggacgacgagaacgccaccgccuccuucaucuacaacggccgccugguggacagcaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgucgcuguccgggagcgcccagcacguggaggagugcuccugcuacccccgcuaccccggcgugcggugcgucugccgcgacaacuggaagggcucgaaccggccgaucguggacaucaacgugaaggacuacuccaucgucagcuccuacgugugcucggggcucgugggcgacacgccccgcaagaacgacuccucguccagcucccacugccuggaccccaacaacgaggagggcgggcacggggucaagggcugggccuucgacgacggcaacgacguguggauggggcggaccaucucggagaagcugcgcuccggcuacgagaccuucaaggucaucgagggguggagcaagcccaacuccaagcuccagaccaaccgccaggugaucguggaccggggcaaccggucgggguacuccggcaucuucucggucgagagcaaguccugcaucaaccgcugcuucuacguggagcugauccggggccgcaagcaggagaccgaggugcuguggaccucgaacuccaucgucguguucugcgggaccagcggcacguacgggaccggcuccuggccggacggggccgacaucaaccucaugcccaucuga

SEQ ID NO: 24233 - RNA, 1410 nt, Artificial Sequence; identical to SEQ ID NO: 23545
  derived and/or modified CDS sequence (AUadapt) from InfluenzaA__AFF18509__NA

SEQ ID NO: 24234 - RNA, 1410 nt, Artificial Sequence
  derived and/or modified CDS sequence (AUadapt) from InfluenzaA__AFF57129__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaacggcaccgacaacaacuucucgaucaagcaggacaucgucgggaucaacgagugguccggcuacagcggguccuucgugcagcacccggagcugaccggccuggacugcauccgccccugcuucuggguggagcucauccggggccgccccaaggagaacacgaucuggaccagcggguccagcaucuccuucugcggcgucaacagcgacaccguggggugguccuggcccgacggcgccgagcugccguucaccaucgacaaguga

SEQ ID NO: 24235 - RNA, 1410 nt, Artificial Sequence
  derived and/or modified CDS sequence (AUadapt) from InfluenzaA__AFF57133__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccuggcugaaccagaccuacgugaacaucagcaacacgaacuucgccgcgggccaguccguggucucggugaagcucgccgggaacuccagccugugcccgguguccggcugggccaucuacagcaaggacaacuccauccgcaucggcagcaagggggacgucuucgugauccgggagcccuucaucuccugcagccccuccgagugccgcaccuucuuccugacccagggcgcccuccugaacgacaagcacucgaacgggaccaucaaggaccggucccccuaccgcacgcugaugagcugcccgaucggcgaggugcccagccccuacaacucccgguucgagagcgucgccugguccgcgagcgccugccacgacgggaucaacuggcucaccaucggcaucuccggccccgacaacggggccguggccgugcugaaguacaacggcaucaucaccgacaccaucaagucguggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucagcuucaaguacggcaacgggguguggaucggccgcaccaaguccaucagcucccggaagggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 24236 - RNA, 1410 nt, Artificial Sequence; identical to SEQ ID NO: 19295
  derived and/or modified CDS sequence (AUadapt) from InfluenzaA__AFF57137__NA

SEQ ID NO: 24237 - RNA, 1410 nt, Artificial Sequence; identical to SEQ ID NO: 19295
  derived and/or modified CDS sequence (AUadapt) from InfluenzaA__AFF57141__NA

SEQ ID NO: 24238 - RNA, 1410 nt, Artificial Sequence; identical to SEQ ID NO: 19295
  derived and/or modified CDS sequence (AUadapt) from InfluenzaA__AFF57145__NA

SEQ ID NO: 24239 - RNA, 1410 nt, Artificial Sequence; identical to SEQ ID NO: 19295
  derived and/or modified CDS sequence (AUadapt) from InfluenzaA__AFF57149__NA

SEQ ID NO: 24240 - RNA, 1410 nt, Artificial Sequence; identical to SEQ ID NO: 19295
  derived and/or modified CDS sequence (AUadapt) from InfluenzaA__AFF57153__NA

SEQ ID NO: 24241 - RNA, 1410 nt, Artificial Sequence; identical to SEQ ID NO: 19295
  derived and/or modified CDS sequence (AUadapt) from InfluenzaA__AFF57157__NA

SEQ ID NO: 24242 - RNA, 1410 nt, Artificial Sequence; identical to SEQ ID NO: 19295
  derived and/or modified CDS sequence (AUadapt) from InfluenzaA__AFF57161__NA

SEQ ID NO: 24243 - RNA, 1410 nt, Artificial Sequence; identical to SEQ ID NO: 19295
  derived and/or modified CDS sequence (AUadapt) from InfluenzaA__AFF57165__NA

SEQ ID NO: 24244 - RNA, 1410 nt, Artificial Sequence; identical to SEQ ID NO: 19295
  derived and/or modified CDS sequence (AUadapt) from InfluenzaA__AFF57169__NA

SEQ ID NO: 24245 - RNA, 1410 nt, Artificial Sequence; identical to SEQ ID NO: 19295
  derived and/or modified CDS sequence (AUadapt) from InfluenzaA__AFF57173__NA

SEQ ID NO: 24246 - RNA, 1410 nt, Artificial Sequence; identical to SEQ ID NO: 19295
  derived and/or modified CDS sequence (AUadapt) from InfluenzaA__AFF57177__NA

SEQ ID NO: 24247 - RNA, 1410 nt, Artificial Sequence; identical to SEQ ID NO: 19295
  derived and/or modified CDS sequence (AUadapt) from InfluenzaA__AFF57181__NA

SEQ ID NO: 24248 - RNA, 1410 nt, Artificial Sequence; identical to SEQ ID NO: 19295
  derived and/or modified CDS sequence (AUadapt) from InfluenzaA__AFF57185__NA

SEQ ID NO: 24249 - RNA, 1410 nt, Artificial Sequence; identical to SEQ ID NO: 19295
  derived and/or modified CDS sequence (AUadapt) from InfluenzaA__AFF57189__NA

SEQ ID NO: 24250 - RNA, 1350 nt, Artificial Sequence
  derived and/or modified CDS sequence (AUadapt) from InfluenzaA__AFF60789__NA
augaaucccaacaagaagaucaucaccaucggcucgaucugcauggugaccgggauggucucccugaugcuccagaucggcaaccugaucagcaucugggugucccacagcauccauacggggaaccagcacaaggccgagccgaucuccaacaccaacuuccugaccgagaaggccguggcgagcgucaagcucgccggcaacuccagucugugccccaucaacgggugggccguguacuccaaggacaacagcauccgcaucggcuccaagggcgacguguuugucauccgggagcccuucaucagcugcucccaccuggagugccgcaccuucuuccucacgcagggggcccugcugaaugacaagcacagcaacggcaccgugaaggaccggagcccccaccgcacccucauguccuguccggugggggaggcccccucccccuacaacagccgguucgaguccgucgcguggagcgccagcgccugccaugacggcaccuccuggcugacgaucgggaucagcggccccgacaacggcgccguggcggugcugaaguacaacgggaucaucaccgacaccaucaaguccuggcgcaauaacauccuccggacccaggagagcgagugcgccugcgucaacggcuccugcuucacggugaugaccgaugggccgucgaacggccaggccucccacaagaucuucaagauggagaagggcaagguggucaagagcguggagcuggacgcccccaacuaucacuacgaggagugcuccugcuaccccgacgccggggagaucacgugcgugugucgcgacaacuggcacggcagcaaccggcccugggucuccuucaaccagaaucuggaguaccagaucggguacaucugcagcggcguguucggggacaacccgcgccccaaugacggcaccggcuccugcgggcccgugagcuccaacggcgcguacggggucaagggcuucagcuuuaaguacgggaacggcguguggaucggccggaccaaguccaccaacagccgcuccggguucgagaugaucugggaccccaacggcuggaccgagaccgauagcagcuucuccgugaagcaggacaucgucgccaucacggacuggagcggguacuccggcaguuucgugcagcacccggagcucaccgggcuggacugcauccggcccugcuucugggucgagcugauccgcggccggcccaaggaguccaccaucuggaccagcggcuccaguaucuccuucugcggggugacgagcgacaccgugggcugguccuggcccgacggggccgagcucccguucaccaucgacaaguga

SEQ ID NO: 24251 - RNA, 1410 nt, Artificial Sequence
  derived and/or modified CDS sequence (AUadapt) from InfluenzaA__AFG29043__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccauccgggaccgcucccccuaccggacgcugaugucgugcccgaucggcgagguccccucccccuacaacagccgcuucgagagcguggccugguccgcgagcgccugccacgacgggaucaacuggcucaccaucggcaucuccggccccgacaacggggccguggccguccugaaguacaacggcaucaucaccgacaccaucaagagcuggcggaacaacauccugcgcacgcaggaguccgagugcgcgugcgugaacgggucgugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucucguucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 24252 - RNA, 1410 nt, Artificial Sequence; identical to SEQ ID NO: 20921
  derived and/or modified CDS sequence (AUadapt) from InfluenzaA__AFG29045__NA

SEQ ID NO: 24253 - RNA, 1410 nt, Artificial Sequence; identical to SEQ ID NO: 21053
  derived and/or modified CDS sequence (AUadapt) from InfluenzaA__AFG31063__NA

SEQ ID NO: 24254 - RNA, 1410 nt, Artificial Sequence; identical to SEQ ID NO: 16318
  derived and/or modified CDS sequence (AUadapt) from InfluenzaA__AFG31073__NA

SEQ ID NO: 24255 - RNA, 1410 nt, Artificial Sequence
  derived and/or modified CDS sequence (AUadapt) from InfluenzaA__AFG31083__NA
augaaccccaaccagaagaucaucaccaucggcucggugugcaugaccaucgggauggccaaccugauccuccagaucggcaacaucaucuccaucuggaucagccacuccauccagcuggucaaccagaaccagaucgagacgugcaaccagagcgugaucaccuacgagaacaacaccugggugaaccagaccuacgucaacaucuccaacacgaacuucgccgcggggcagagcgugguguccgucaagcuggccggcaacagcucccucugcccggugucggggugggccaucuacuccaaggacaacagcgugcgcaucggcuccaagggcgacgucuucgugauccgggagcccuucaucagcugcagcccccuggagugccgcaccuucuuccugacccagggggcccuccugaacgacaagcacuccaacggcaccaucaaggaccggucccccuaccgcacgcugaugagcugcccgaucggggaggugcccucccccuacaacagccgguucgagucggucgccugguccgcgagcgccugccacgacggcaucaacuggcucaccaucgggaucuccggccccgacaacggcgccguggccgugcugaaguacaacgggaucaucaccgacaccaucaagagcuggcgcaacaacauccugcggacgcaggaguccgagugcgcgugcgucaacggcagcugcuucaccgugaugaccgacgggccguccaacggccaggccagcuacaagaucuuccgcaucgagaagggcaagaucgugaaguccgucgagaugaacgcccccaacuaccacuacgaggagugcucgugcuaccccgacuccagcgagaucacgugcgugugccgggacaacuggcacggguccaaccgccccugggugagcuucaaccagaaccucgaguaccagaucggcuacaucugcuccgggaucuucggcgacaacccgcggcccaacgacaagaccgggagcugcggccccgucuccagcaacggcgccaacggggugaagggcuucuccuucaaguacgggaacggcguguggaucgggcgcaccaagagcaucucgucccggaacggcuucgagaugaucugggaccccaacggcuggaccgggaccgacaacaacuucagcaucaagcaggacaucgucggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgugggcugguccuggcccgacggggccgagcugccguucacgaucgacaaguga

SEQ ID NO: 24256 - RNA, 1410 nt, Artificial Sequence; identical to SEQ ID NO: 16318
  derived and/or modified CDS sequence (AUadapt) from InfluenzaA__AFG31093__NA

SEQ ID NO: 24257 - RNA, 1410 nt, Artificial Sequence; identical to SEQ ID NO: 16318
  derived and/or modified CDS sequence (AUadapt) from InfluenzaA__AFG31103__NA

SEQ ID NO: 24258 - RNA, 1410 nt, Artificial Sequence; identical to SEQ ID NO: 16318
  derived and/or modified CDS sequence (AUadapt) from InfluenzaA__AFG31113__NA

SEQ ID NO: 24259 - RNA, 1410 nt, Artificial Sequence; identical to SEQ ID NO: 16318
  derived and/or modified CDS sequence (AUadapt) from InfluenzaA__AFG31123__NA

SEQ ID NO: 24260 - RNA, 1410 nt, Artificial Sequence; identical to SEQ ID NO: 16318
  derived and/or modified CDS sequence (AUadapt) from InfluenzaA__AFG31133__NA

SEQ ID NO: 24261 - RNA, 1410 nt, Artificial Sequence; identical to SEQ ID NO: 16318
  derived and/or modified CDS sequence (AUadapt) from InfluenzaA__AFG31143__NA

SEQ ID NO: 24262 - RNA, 1410 nt, Artificial Sequence; identical to SEQ ID NO: 16318
  derived and/or modified CDS sequence (AUadapt) from InfluenzaA__AFG31153__NA

SEQ ID NO: 24263 - RNA, 1410 nt, Artificial Sequence; identical to SEQ ID NO: 16318
  derived and/or modified CDS sequence (AUadapt) from InfluenzaA__AFG31163__NA

SEQ ID NO: 24264 - RNA, 1410 nt, Artificial Sequence
  derived and/or modified CDS sequence (AUadapt) from InfluenzaA__AFG31173__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccugcccaaggagaacaccaucuggaccagcggguccagcaucuccuucugcggcgugaacagcgacaccgucgggugguccuggcccgacggcgccgagcugccguucacgaucgacaaguga

SEQ ID NO: 24265 - RNA, 1410 nt, Artificial Sequence; identical to SEQ ID NO: 24264
  derived and/or modified CDS sequence (AUadapt) from InfluenzaA__AFG31183__NA

SEQ ID NO: 24266 - RNA, 1410 nt, Artificial Sequence; identical to SEQ ID NO: 16318
  derived and/or modified CDS sequence (AUadapt) from InfluenzaA__AFG31193__NA

SEQ ID NO: 24267 - RNA, 1410 nt, Artificial Sequence; identical to SEQ ID NO: 16318
  derived and/or modified CDS sequence (AUadapt) from InfluenzaA__AFG31203__NA

SEQ ID NO: 24268 - RNA, 1410 nt, Artificial Sequence; identical to SEQ ID NO: 16318
  derived and/or modified CDS sequence (AUadapt) from InfluenzaA__AFG31213__NA

SEQ ID NO: 24269 - RNA, 1410 nt, Artificial Sequence; identical to SEQ ID NO: 16318
  derived and/or modified CDS sequence (AUadapt) from InfluenzaA__AFG31223__NA

SEQ ID NO: 24270 - RNA, 1410 nt, Artificial Sequence; identical to SEQ ID NO: 16318
  derived and/or modified CDS sequence (AUadapt) from InfluenzaA__AFG31233__NA

SEQ ID NO: 24271 - RNA, 1410 nt, Artificial Sequence
  derived and/or modified CDS sequence (AUadapt) from InfluenzaA__AFG31243__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgucgccggccagagcgugguguccgucaagcuggcggggaacagcucccucugcccggugucgggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagucgguggccugguccgccagcgcgugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgccugcgugaacgggagcugcuucaccgucaugaccgacggcccguccgacggccaggcgagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 24272 - RNA, 1410 nt, Artificial Sequence; identical to SEQ ID NO: 22132
  derived and/or modified CDS sequence (AUadapt) from InfluenzaA__AFG31253__NA

SEQ ID NO: 24273 - RNA, 1410 nt, Artificial Sequence; identical to SEQ ID NO: 16318
  derived and/or modified CDS sequence (AUadapt) from InfluenzaA__AFG31263__NA

SEQ ID NO: 24274 - RNA, 1410 nt, Artificial Sequence; identical to SEQ ID NO: 16318
  derived and/or modified CDS sequence (AUadapt) from InfluenzaA__AFG31273__NA

SEQ ID NO: 24275 - RNA, 1410 nt, Artificial Sequence; identical to SEQ ID NO: 16318
  derived and/or modified CDS sequence (AUadapt) from InfluenzaA__AFG31283__NA

SEQ ID NO: 24276 - RNA, 1410 nt, Artificial Sequence; identical to SEQ ID NO: 16318
  derived and/or modified CDS sequence (AUadapt) from InfluenzaA__AFG31293__NA

SEQ ID NO: 24277 - RNA, 1410 nt, Artificial Sequence; identical to SEQ ID NO: 16318
  derived and/or modified CDS sequence (AUadapt) from InfluenzaA__AFG31303__NA

SEQ ID NO: 24278 - RNA, 1410 nt, Artificial Sequence; identical to SEQ ID NO: 16318
  derived and/or modified CDS sequence (AUadapt) from InfluenzaA__AFG31313__NA

SEQ ID NO: 24279 - RNA, 1410 nt, Artificial Sequence; identical to SEQ ID NO: 16318
  derived and/or modified CDS sequence (AUadapt) from InfluenzaA__AFG31326__NA

SEQ ID NO: 24280 - RNA, 1410 nt, Artificial Sequence; identical to SEQ ID NO: 16318
  derived and/or modified CDS sequence (AUadapt) from InfluenzaA__AFG31336__NA

SEQ ID NO: 24281 - RNA, 1410 nt, Artificial Sequence; identical to SEQ ID NO: 22132
  derived and/or modified CDS sequence (AUadapt) from InfluenzaA__AFG31346__NA

SEQ ID NO: 24282 - RNA, 1410 nt, Artificial Sequence; identical to SEQ ID NO: 22132
  derived and/or modified CDS sequence (AUadapt) from InfluenzaA__AFG31356__NA

SEQ ID NO: 24283 - RNA, 1410 nt, Artificial Sequence; identical to SEQ ID NO: 22132
  derived and/or modified CDS sequence (AUadapt) from InfluenzaA__AFG31366__NA

SEQ ID NO: 24284 - RNA, 1410 nt, Artificial Sequence; identical to SEQ ID NO: 22132
  derived and/or modified CDS sequence (AUadapt) from InfluenzaA__AFG31379__NA

SEQ ID NO: 24285 - RNA, 1410 nt, Artificial Sequence; identical to SEQ ID NO: 22132
  derived and/or modified CDS sequence (AUadapt) from InfluenzaA__AFG31389__NA

SEQ ID NO: 24286 - RNA, 1410 nt, Artificial Sequence; identical to SEQ ID NO: 22132
  derived and/or modified CDS sequence (AUadapt) from InfluenzaA__AFG31399__NA

SEQ ID NO: 24287 - RNA, 1410 nt, Artificial Sequence; identical to SEQ ID NO: 22132
  derived and/or modified CDS sequence (AUadapt) from InfluenzaA__AFG31409__NA

SEQ ID NO: 24288 - RNA, 1410 nt, Artificial Sequence; identical to SEQ ID NO: 16318
  derived and/or modified CDS sequence (AUadapt) from InfluenzaA__AFG31419__NA

SEQ ID NO: 24289 - RNA, 1410 nt, Artificial Sequence; identical to SEQ ID NO: 16318
  derived and/or modified CDS sequence (AUadapt) from InfluenzaA__AFG31429__NA

SEQ ID NO: 24290 - RNA, 1410 nt, Artificial Sequence; identical to SEQ ID NO: 16318
  derived and/or modified CDS sequence (AUadapt) from InfluenzaA__AFG31439__NA

SEQ ID NO: 24291 - RNA, 1410 nt, Artificial Sequence; identical to SEQ ID NO: 16318
  derived and/or modified CDS sequence (AUadapt) from InfluenzaA__AFG31449__NA

SEQ ID NO: 24292 - RNA, 1410 nt, Artificial Sequence; identical to SEQ ID NO: 16318
  derived and/or modified CDS sequence (AUadapt) from InfluenzaA__AFG31459__NA

SEQ ID NO: 24293 - RNA, 1410 nt, Artificial Sequence; identical to SEQ ID NO: 16318
  derived and/or modified CDS sequence (AUadapt) from InfluenzaA__AFG31469__NA

SEQ ID NO: 24294 - RNA, 1410 nt, Artificial Sequence; identical to SEQ ID NO: 16318
  derived and/or modified CDS sequence (AUadapt) from InfluenzaA__AFG31479__NA

SEQ ID NO: 24295 - RNA, 1410 nt, Artificial Sequence; identical to SEQ ID NO: 16318
  derived and/or modified CDS sequence (AUadapt) from InfluenzaA__AFG31499__NA

SEQ ID NO: 24296 - RNA, 1410 nt, Artificial Sequence; identical to SEQ ID NO: 21031
  derived and/or modified CDS sequence (AUadapt) from InfluenzaA__AFG31509__NA

SEQ ID NO: 24297 - RNA, 1410 nt, Artificial Sequence; identical to SEQ ID NO: 22132
  derived and/or modified CDS sequence (AUadapt) from InfluenzaA__AFG31519__NA

SEQ ID NO: 24298 - RNA, 1410 nt, Artificial Sequence; identical to SEQ ID NO: 16318
  derived and/or modified CDS sequence (AUadapt) from InfluenzaA__AFG31529__NA

SEQ ID NO: 24299 - RNA, 1410 nt, Artificial Sequence; identical to SEQ ID NO: 21031
  derived and/or modified CDS sequence (AUadapt) from InfluenzaA__AFG31539__NA

SEQ ID NO: 24300 - RNA, 1410 nt, Artificial Sequence; identical to SEQ ID NO: 16318
  derived and/or modified CDS sequence (AUadapt) from InfluenzaA__AFG31549__NA

SEQ ID NO: 24301 - RNA, 1410 nt, Artificial Sequence; identical to SEQ ID NO: 16318
  derived and/or modified CDS sequence (AUadapt) from InfluenzaA__AFG31559__NA

SEQ ID NO: 24302 - RNA, 1410 nt, Artificial Sequence; identical to SEQ ID NO: 22132
  derived and/or modified CDS sequence (AUadapt) from InfluenzaA__AFG31569__NA

SEQ ID NO: 24303 - RNA, 1410 nt, Artificial Sequence; identical to SEQ ID NO: 16318
  derived and/or modified CDS sequence (AUadapt) from InfluenzaA__AFG31579__NA

SEQ ID NO: 24304 - RNA, 1410 nt, Artificial Sequence; identical to SEQ ID NO: 16318
  derived and/or modified CDS sequence (AUadapt) from InfluenzaA__AFG31589__NA

SEQ ID NO: 24305 - RNA, 1410 nt, Artificial Sequence; identical to SEQ ID NO: 16318
  derived and/or modified CDS sequence (AUadapt) from InfluenzaA__AFG31599__NA

SEQ ID NO: 24306 - RNA, 1410 nt, Artificial Sequence; identical to SEQ ID NO: 16318
  derived and/or modified CDS sequence (AUadapt) from InfluenzaA__AFG31609__NA

SEQ ID NO: 24307 - RNA, 1410 nt, Artificial Sequence; identical to SEQ ID NO: 16318
  derived and/or modified CDS sequence (AUadapt) from InfluenzaA__AFG31619__NA

SEQ ID NO: 24308 - RNA, 1410 nt, Artificial Sequence; identical to SEQ ID NO: 16318
  derived and/or modified CDS sequence (AUadapt) from InfluenzaA__AFG31629__NA

SEQ ID NO: 24309 - RNA, 1410 nt, Artificial Sequence; identical to SEQ ID NO: 22132
  derived and/or modified CDS sequence (AUadapt) from InfluenzaA__AFG31639__NA

SEQ ID NO: 24310 - RNA, 1410 nt, Artificial Sequence; identical to SEQ ID NO: 16318
  derived and/or modified CDS sequence (AUadapt) from InfluenzaA__AFG31649__NA

SEQ ID NO: 24311 - RNA, 1410 nt, Artificial Sequence; identical to SEQ ID NO: 16318
  derived and/or modified CDS sequence (AUadapt) from InfluenzaA__AFG31659__NA

SEQ ID NO: 24312 - RNA, 1410 nt, Artificial Sequence; identical to SEQ ID NO: 16318
  derived and/or modified CDS sequence (AUadapt) from InfluenzaA__AFG31669__NA

SEQ ID NO: 24313 - RNA, 1410 nt, Artificial Sequence; identical to SEQ ID NO: 16337
  derived and/or modified CDS sequence (AUadapt) from InfluenzaA__AFG71868__NA

SEQ ID NO: 24314 - RNA, 1410 nt, Artificial Sequence; identical to SEQ ID NO: 16337
  derived and/or modified CDS sequence (AUadapt) from InfluenzaA__AFG71890__NA

SEQ ID NO: 24315 - RNA, 1410 nt, Artificial Sequence; identical to SEQ ID NO: 16337
  derived and/or modified CDS sequence (AUadapt) from InfluenzaA__AFG71901__NA

SEQ ID NO: 24316 - RNA, 1410 nt, Artificial Sequence; identical to SEQ ID NO: 16516
  derived and/or modified CDS sequence (AUadapt) from InfluenzaA__AFG71912__NA

SEQ ID NO: 24317 - RNA, 1410 nt, Artificial Sequence
  derived and/or modified CDS sequence (AUadapt) from InfluenzaA__AFG71934__NA
augaaccccaaccagaagaucaucaccaucggcucggugucccugaccaucgccacggucugcuuccucaugcagaucgccauccugaucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccuggacaacaagcacucgaacgacacgauccacgaccgcaucccgcaccggacccugcucaugaacgagcugggcgugcccuuccaccuggggacccgccaggugugcaucgccugguccagcuccucgugccacgacggcaaggcguggcuccacgucugcgugaccggggacgacaagaacgccacggccuccuucaucuacgacggccggcugguggacucgaucggguccuggagccagaacauccugcgcacccaggaguccgagugcgucugcaucaacgggaccugcaccguggugaugacggacggcucggccuccggccgggcggacacccgcauccucuucaucgaggagggcaagaucguccacaucucgccccugagcggguccgcccagcacguggaggagugcucgugcuacccccgguacccgggcgugcgcugcaucugccgggacaacuggaagggcuccaaccgccccgucguggacaucaacgugaaggacuacucgaucgacucccgguacgucugcagcgggcuggugggcgacacgccccgcaacaacgaccgguucuccaacucgaacugccgcaaccccaacaacgagcgggggaaccacggcgugaaggggugggccuucgacgacggcaacgacgucuggaugggccgcaccaucuccaaggacucgcgguccggguacgagaccuucaaggugaucggcggguggagcaccccgaacuccaagucgcagaucaaccgccaggucaucguggacuccgacaaccgcucgggcuacuccgggaucuucagcguggagggcaaguccugcaucaaccggugcuucuacgucgagcucauccgcggccgggagcaggagacccgcgugugguggaccucgaacucgaucguggucuucugcgggacguccggcaccuacgggaccggcagcuggcccgacggggccgacaucaaccugaugcccaucuga

SEQ ID NO: 24318 - RNA, 1410 nt, Artificial Sequence
  derived and/or modified CDS sequence (AUadapt) from InfluenzaA__AFG71945__NA
augaaccccaaccagaagaucaucaccaucggcucggugucccugaccaucgccacggucugcuuccucaugcagaucgccauccuggugaccaccgugacccugcacuucaagcaguacgagugcgacucgccggcgaacaaccaggucaugcccugcgagcccaucaucaucgagcgcaacaucacggagaucguguaccucaccaacaccaccaucgagaaggagaucugccccaagcugguggaguaccggaacugguccaagccgcagugcaagaucacgggguucgcccccuucucgaaggacaacuccauccgccugagcgccggcggggacaucugggucacccgggagcccuacguguccugcgaccccggcaagugcuaccaguucgcccucgggcagggcaccacccuggacaacaagcacucgaacgacacgauccacgaccgcaucccgcaccggacccugcucaugaacgagcugggcgugcccuuccaccuggggacccgccaggucugcaucgccugguccucguccagcugccacgacggcaaggcguggcuccacgugugcgugaccggggacgacgagaacgccacggccuccuucaucuacgacggccggcuggucgacucgaucggguccuggucgcagaacauccugcgcacccaggaguccgagugcgugugcaucaacgggaccugcaccguggucaugacggacggcagcgccuccggccgggcggacacccgcauccucuucaucgaggagggcaagaucgugcacaucucgccccugucgggguccgcccagcacguggaggagugcagcugcuacccccgguacccgggcguccgcugcaucugccgggacaacuggaagggcuccaaccgccccgugguggacaucaacgucaaggacuacucgaucgacucccgguacgugugcucggggcuggugggcgacacgccccgcaacaacgacaaguccagcaacuccaacugccggaaccccaacaacgacaaggggaaccacggcgucaaggggugggccuucgacgacggcaacgacguguggaugggccgcaccaucucgaaggacucccggucgggguacgagaccuucaaggucaucggcgggugguccaccccgaacagcaagucccagaucaaccgccaggugaucguggacucggacaaccgguccggcuacucggggaucuucuccgucgagggcaagagcugcaucaaccgcugcuucuacguggagcucauccgcggccgggagcaggagaccaaggugugguggaccucgaacuccaucgucguguucugcgggacgucgggcaccuacgggaccggcuccuggcccgacggggccgacaucaaccugaugagcaucuga

SEQ ID NO: 24319 - RNA, 1410 nt, Artificial Sequence; identical to SEQ ID NO: 16520
  derived and/or modified CDS sequence (AUadapt) from InfluenzaA__AFG71967__NA

SEQ ID NO: 24320 - RNA, 1410 nt, Artificial Sequence; identical to SEQ ID NO: 16520
  derived and/or modified CDS sequence (AUadapt) from InfluenzaA__AFG71978__NA

SEQ ID NO: 24321 - RNA, 1410 nt, Artificial Sequence
  derived and/or modified CDS sequence (AUadapt) from InfluenzaA__AFG71988__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccuggacaacaagcacucgaacgacacgauccacgaccgcaccccgcaccggacccugcucaugaacgagcugggcgugcccuuccaccuggggacccgccaggugugcaucgccugguccagcuccucgugccacgacggcaaggcguggcuccacgucugcgugacgggguacgacaagaacgccaccgccuccuucaucuacgacggccggcugguggacagcaucggguccuggucgcagaacauccugcgcacccaggaguccgagugcaucugcaucaacgggaccugcacggucgugaugaccgacggcucggccuccggccgggcggacaccaagauccucuucaucgaggagggcaagaucgugcacaucagcccccugucgggguccgcccagcacgucgaggagugcucgugcuacccccgcuacccgggcgugcggugcaucugccgcgacaacuggaagggcuccaaccggcccguggucgacaucaacgugaaggacuacagcaucgacuccucguacgugugcuccgggcuggucggcgacacgccccgcaacaacgaccggagcuccaacucguacugccgcaaccccaacaacgagaaggggaaccacggcgugaaggggugggccuucgacgacggcaacgacguguggaugggccggaccaucuccgaggacucgcgcuccggguacgagaccuucaaggucaucggcggguggagcaccccgaacuccaagcuccagaucaaccgccaggugaucgucgacucggacaaccgguccggcuacucggggaucuucuccguggagggcaagagcugcaucaaccggugcuucuacguggagcugauccgcggccgcgagcaggagacccgggucugguggacgucgaacuccaucgugguguucugcgggaccagcggcaccuacgggaccggcuccuggcccgacggggccgacaucaaccugaugcccaucuga

SEQ ID NO: 24322 - RNA, 1410 nt, Artificial Sequence; identical to SEQ ID NO: 16520
  derived and/or modified CDS sequence (AUadapt) from InfluenzaA__AFG71999__NA

SEQ ID NO: 24323 - RNA, 1410 nt, Artificial Sequence; identical to SEQ ID NO: 16978
  derived and/or modified CDS sequence (AUadapt) from InfluenzaA__AFG72021__NA

SEQ ID NO: 24324 - RNA, 1410 nt, Artificial Sequence
  derived and/or modified CDS sequence (AUadapt) from InfluenzaA__AFG72032__NA
augaaccccaaccagaagaucaucaccaucggcucggugucccugaccaucgccacgaucugcuuccucaugcagaucgccauccuggucaccaccgugacccugcacuucaagcaguacgagugcagcuccccgcccaacaaccaggugaugcccugcgagcccaucaucaucgagcgcaacaucacggagaucgucuaccucaccaacaccaccaucgagaaggagaucugcccgaagcugguggaguaccggaacuggucgaagccccagugcaagaucacgggguucgcgcccuucuccaaggacaacagcauccgccuguccgccggcggggacaucugggugacccgggagcccuacgucucgugcgacccgggcaagugcuaccaguucgcccucgggcagggcaccacccuggacaacaagcacuccaacgacacgauccacgaccgcacccccuaccggacccugcucaugaacgagcugggcgugcccuuccaccuggggacccgccaggugugcaucgccuggagcuccucguccugccacgacggcaaggccuggcuccacgucugcgugacgggguacgacaagaacgcgaccgccagcuucaucuacgacggccggcugguggacuccaucgggucgugguccaagaacauccugcgcacccaggagagcgagugcgucugcaucaacgggaccugcacgguggugaugaccgacggcuccgccucggagcgggccgacaccaagauccucuucaucgaggagggcaagaucguccacaucagcccccuguccggcucggcgcagcacguggaggagugcuccugcuacccgcgcuaccccggggugcggugcgucugccgcgacaacuggaagggcagcaaccggcccgugguggacaucaacgucaaggacuacuccaucgugucguccuacgugugcagcggccuggucggggacacgccccgcaagaacgaccgguccucguccagcuacugccgcaacccgaacaacgagaagggcaaccacggggugaagggcugggccuucgacgacgggaacgacgucuggaugggccggaccaucuccgaggagucgcgcuccggcuacgagaccuucaaggugaucgggggcuggagcacccccaacuccaagcuccagaucaaccgccaggugaucgucgacucggacaaccgguccggguacagcggcaucuucucgguggaggggaaguccugcaucaaccggugcuucuacguggagcugauccgcggccgcgagcaggagacccgggucugguggacgagcaacuccaucgugguguucugcggcaccagcgggaccuacggcaccggguccuggcccgacggcgccgacaucaaccugaugcccaucuga

SEQ ID NO: 24325 - RNA, 1410 nt, Artificial Sequence; identical to SEQ ID NO: 17215
  derived and/or modified CDS sequence (AUadapt) from InfluenzaA__AFG72088__NA

SEQ ID NO: 24326 - RNA, 1410 nt, Artificial Sequence
  derived and/or modified CDS sequence (AUadapt) from InfluenzaA__AFG72121__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccgcgugaugcccugcgagcccacgaucaucgagcggaacaucaccgagaucgucuaccucaccaacaccacgaucgagaaggagaucugcccgaagcugguggaguaccgcaacuggagcaagccccagugcaagaucaccggguucgcgcccuucuccaaggacaacucgauccggcuguccgccggcggggacaucugggugacccgcgagcccuacgucagcugcgacccgggcaagugcuaccaguucgcccucgggcagggcaccacgcugaacaaccggcacuccaacgacaccgugcacgaccgcacccccuaccggacccugcucaugaacgagcugggcgugcccuuccaccuggggacgaagcaggucugcauggccuggucguccagcuccugccacgacggcaaggccuggcuccacgugugcgugaccgggcacgacgagaacgcgaccgccucguucaucuacgacggccgccuggucgacuccaucgggucgugguccaagaacauccugcggacccaggagagcgagugcgugugcaucaacggcacgugcaccguggucaugaccgacggcuccgccucggagcgcgccgacaccaagauccucuucaucgaggaggggaagaucgugcacaucagcccccuguccggcucggcgcagcacguggaggagugcuccugcuacccgcgguaccccgggguccgcugcgugugccgggacaacuggaagggcagcaaccgccccaucguggacaucaacgucaaggacuacuccaucgugucguccuacgugugcagcggccuggucggggacacgccccggaagaacgaccgcuccucguccucguacugccggaacccgaacaacgagaagggcucccacggggugaagggcugggccuucgacgacgggaacgacgucuggaugggccgcaccaucggcgaggagcuccggagcggguacgagaccuucaaggugaucggcgggugguccacccccaacucgaagcugcagaucaaccgccaggugaucgucgacuccggcaaccggagcggguacuccggcaucuucucgguggagggcaagagcugcaucaaccgcugcuucuacguggagcugauccgcgggcggaagcaggagacgcgcgucugguggaccuccaacucgaucgugguguucugcggcaccuccgggaccuacggcacggggagcuggcccgacggcgccgacaucaaccucaugcccaucuga

SEQ ID NO: 24327 - RNA, 1410 nt, Artificial Sequence
  derived and/or modified CDS sequence (AUadapt) from InfluenzaA__AFG72143__NA
augaaccccaaccagaagaucaucaccaucggcucggugucccugaccaucgccacgaucugccuccugaugcagaucgccauccuggucaccaccgugacccuccacuucaagcaguacgagugcucguccccgcccaacaaccaggugaugcccugcgagcccacgaucaucgagcgcaacaucaccgagaucgucuaccugaccaacaccacgaucgagaaggagaucugcccgaagcugguggaguaccggaacuggagcaagccccagugcaagaucaccggguucgcgcccuucuccaaggacaacucgauccgccucuccgccggcggggacaucugggugacccgggagcccuacgucagcugcgacccgggcaagugcuaccaguucgcccuggggcagggcaccacgcugaacaaccgccacuccaacgacaccgugcacgaccggacccccuaccgcacccuccugaugaacgagcugggcgugcccuuccaccucgggacgaagcaggucugcaucgccuggucguccagcuccugccacgacggcaaggccuggcugcacgugugcgugaccgggcacgacgagaacgcgaccgccucguucaucuacgacggccggcuggucgacuccaucgggucgugguccaagaacauccuccgcacccaggagagcgagugcgugugcaucaacggcacgugcaccguggucaugaccgacggcuccgccucggagcgggccgacaccaagauccuguucaucgaggaggggaagaucgugcacaucagcccccuguccggcucggcgcagcacguggaggagugcuccugcuacccgcgcuaccccgggguccggugcgugugccgcgacaacuggaagggcagcaaccggcccaucguggacaucaacgucaaggacuacuccaucgugucguccuacgugugcagcggccucgucggggacacgccccgcaagaacgacuccucguccucguccuacugccggaacccgaacaacgagaagggcagccacggggugaagggcugggccuucgacgacgggaacgacgucuggaugggccgcaccaucggcgaggagcugcgguccggguacgagaccuucaaggugaucggcggguggucgacccccaacuccaagcugcagaucaaccgccaggugaucgucgacagcggcaaccgguccggguacucgggcaucuucagcguggagggcaaguccugcaucaaccgcugcuucuacguggagcucauccgggggcgcaagcaggagacgaaggucugguggaccucgaacuccaucgugguguucugcggcaccagcgggaccuacggcacgggguccuggcccgacggcgccgacaucaaccugaugcccaucuga

SEQ ID NO: 24328 - RNA, 1410 nt, Artificial Sequence
  derived and/or modified CDS sequence (AUadapt) from InfluenzaA__AFG72165__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcccugcgagcccacgaucaucgagcgcaacaucaccgagaucgucuaccucaccaacaccacgaucgagaaggagaucugcccgaagcugguggaguaccggaacugguccaagccccagugcaagaucaccggguucgcgcccuucagcaaggacaacuccauccgccugucggccggcggggacaucugggugacccgggagcccuacgucuccugcgacccgggcaagugcuaccaguucgcccucgggcagggcaccacgcugaacaaccgccacagcaacgacaccgugcacgaccggacccccuaccgcacccugcucaugaacgagcugggcgugcccuuccaccuggggacgaagcaggucugcaucgccugguccucguccucgugccacgacggcaaggccuggcuccacgugugcgugaccgggcacgacgagaacgcgaccgccuccuucaucuacgacggccggcuggucgacagcaucguguccuggucgaagaacauccugcgcacccaggaguccgagugcgugugcaucaacgggacgugcaccgucgugaugaccgacggcagcgccuccgagcgggccgacaccaagauccucuucaucgaggagggcaagaucgugcacaucucgccccugagcggguccgcgcagcacgucgaggagugcucgugcuacccgcgcuaccccggcgugcggugcgugugccgcgacaacuggaagggguccaaccggcccaucgucgacaucaacgugaaggacuacucgaucguguccagcuacgucugcuccggccuggugggcgacacgccccgcaagaacgacucguccagcuccucguacugccggaacccgaacaacgagaaggggucccacggcgucaaggggugggccuucgacgacggcaacgacguguggauggggcgcaccaucggcgaggagcuccggucgggcuacgagaccuucaaggugaucgggggcugguccacccccaacagcaagcugcagacgaaccgccaggucaucguggaccgggggaaccgcuccggcuacucggggaucuucuccguggagggcaagagcugcaucaaccggugcuucuacgucgagcugauccgcggccgcaagcaggagaccaaggugugguggaccucgaacuccaucguggucuucugcgggaccagcggcacguacgggaccggcuccuggcccgacggggccgacaucaaccucaugcccaucuga

SEQ ID NO: 24329 - RNA, 1410 nt, Artificial Sequence
  derived and/or modified CDS sequence (AUadapt) from InfluenzaA__AFG72176__NA
augaaccccaaccagaagaucaucaccaucggcucggugucccugaccaucgccacgaucugcuuccucaugcagaucaccauccuggucaccaccgugacgcugcacuucaagcaguacgagugcaacucgccgcccaacaaccaggugaugcucugcgagcccaccaucaucgagcgcaacaucaccgagaucgucuaccugaccaacacgaccaucgagaaggagaagugccccaagcugguggaguaccggaacugguccaagccgcagugcaagaucaccggguucgcccccuucagcaaggacaacuccauccgccucucggcgggcggggacaucugggugacccgggagcccuacgucuccugcgaccccggcaagugcuaccaguucgcccuggggcagggcacgacccugaacaaccgccacagcaacgacaccgugcacgaccggaccccguaccgcacgcuccugaugaacgagcugggcgugcccuuccaccucgggaccaagcaggucugcaucgccugguccucguccagcugccacgacggcaaggccuggcugcacgugugcgugaccgggcacgacgagaacgccaccgcguccuucaucuacgacggccggcuggucgacucgaucggguccuggucgaagaacauccuccgcacgcaggaguccgagugcgugugcaucaacgggaccugcaccguggucaugaccgacggcagcgccuccgagcgggccgacacgaagauccuguucaucgaggagggcaagaucgugcacaucucgccccugagcggcuccgcccagcacguggaggagugcucgugcuacccccgcuacccggggguccggugcgugugccgcgacaacuggaagggcuccaaccggcccaucguggacaucaacgucaaggacuacagcaucguguccucguacgugugcuccggccucgucggggacacgccccgcaagaacgacagcuccucguccucguacugccggaaccccaacaacgagaagggcucccacggggugaagggcugggcguucgacgacgggaacgacgucuggaugggccgcaccaucagcgaggagcugcgguccggcuacgagaccuucaaggugaucgggggcuggucgaccccgaacuccaagcugcagaucaaccgccaggugaucgucgaccgggggaaccgcagcggcuacuccgggaucuucucgguggagggcaagagcugcaucaaccggugcuucuacguggagcucauccgcggccgcaagcaggagaacaaggucugguggaccuccaacucgaucgugguguucugcgggaccuccggcaccuacgggacgggcagcuggcccgacggggccgacaucaaccugaugcccaucuga

SEQ ID NO: 24330 - RNA, 1410 nt, Artificial Sequence; identical to SEQ ID NO: 24328
  derived and/or modified CDS sequence (AUadapt) from InfluenzaA__AFG72198__NA

SEQ ID NO: 24331 - RNA, 1410 nt, Artificial Sequence; identical to SEQ ID NO: 24328
  derived and/or modified CDS sequence (AUadapt) from InfluenzaA__AFG72209__NA

SEQ ID NO: 24332 - RNA, 1410 nt, Artificial Sequence
  derived and/or modified CDS sequence (AUadapt) from InfluenzaA__AFG72220__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucguccaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccucgugccacgacggcaaggcguggcugcacgugugcgugaccgggcacgacgagaacgccaccgccuccuucaucuacgacggccggcugguggacagcaucggguccuggucgaagaacauccuccgcacccaggaguccgagugcgucugcaucaacggcacgugcaccguggugaugaccgacggcagcgccuccgagcgggcggacaccaagauccuguucaucgaggaggggaagaucguccacaucucgccccugucgggcuccgcccagcacguggaggagugcagcugcuacccccgcuacccgggggugcggugcgucugccgcgacaacuggaagggcuccaaccggcccaucguggacaucaacgugaaggacuacucgaucgucuccagcuacgugugcuccggccucgugggggacacgccccgcaagaacgacucguccucguccagcuacugccggaaccccaacaacgagaagggcucccacggggucaagggcugggccuucgacgacgggaacgacguguggaugggccgcaccaucucggaggagcugcgguccggcuacgagaccuucaaggucaucgggggcuggagcaagccgaacuccaagcugcagaucaaccgccaggugaucguggaccgggggaaccgcucgggcuacuccgggaucuucucggucgagggcaagagcugcaucaaccggugcuucuacguggagcucauccgcggccgcaagcaggagaccgaggugugguggacguccaacucgaucgucguguucugcgggaccuccggcaccuacgggaccggcagcuggcccgacggggccgacaucaaccugaugcccaucuga

SEQ ID NO: 24333 - RNA, 1410 nt, Artificial Sequence; identical to SEQ ID NO: 24328
  derived and/or modified CDS sequence (AUadapt) from InfluenzaA__AFG72231__NA

SEQ ID NO: 24334 - RNA, 1410 nt, Artificial Sequence
  derived and/or modified CDS sequence (AUadapt) from InfluenzaA__AFG72297__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagcgggagaucugccccaagcuggcggaguaccgcaacugguccaagccgcagugcaagaucaccggguucgcccccuucagcaaggacaacuccauccggcucucggccggcggggacaucugggugacccgcgagcccuacguguccugcgaccccggcaagugcuaccaguucgcccuggggcagggcaccacgcugaacaaccggcacagcaacgacaccguccacgagcgcaccccguaccggacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccgccugguggacucgaucggguccuggucgaagaacauccuccggacccaggaguccgagugcgucugcaucaacggcacgugcaccguggugaugaccgacggcagcgccuccgagcgcgcggacaccaagauccuguucaucgaggaggggaagaucguccacaucucgccccugagcggcuccgcccagcacguggaggagugcucgugcuacccccgguacccgggggugcgcugcgucugccgggacaacuggaagggcuccaaccgccccaucguggacaucaacgugaaggacuacagcaucgucuccucguacgugugcuccggccucgugggggacacgccccggaagaacgacagcuccucguccucguacugccgcaaccccaacaacgagaagggcucccacggggucaagggcugggccuucgacgacgggaacgacguguggaugggccggaccaucagcgaggagcugcgcuccggcuacgagaccuucaaggucaucgggggcuggucgaagccgaacuccaagcugcagaucaaccgccaggugaucguggaccgggggaaccggagcggcuacuccgggaucuucucggucgagggcaagagcugcaucaaccgcugcuucuacguggagcucauccgcggccggaagcaggagaccgaggugugguggacguccaacucgaucgucguguucugcgggaccuccggcaccuacgggaccggcagcuggcccgacggggccgacaucaaccugaugcccaucuga

SEQ ID NO: 24335 - RNA, 1410 nt, Artificial Sequence
  derived and/or modified CDS sequence (AUadapt) from InfluenzaA__AFG72308__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccuccaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacucgauccgccucuccgccggcggggacaucugggugacccgggagcccuacgugagcugcgaccccggcaagugcuaccaguucgcccuggggcagggcaccacgcugaacaaccgccacuccaacgacaccguccacgaccggaccccguaccgcacccuccugaugaacgagcugggcgugcccuuccaccucgggacgaagcaggucugcaucgccuggucguccagcuccugccacgacggcaaggcguggcugcacgugugcgugaccgggcacgacgagaacgccaccgccucguucaucuacgacggccggcugguggacuccaucgggagcugguccaagaacauccuccgcacccaggagucggagugcgucugcaucaacggcacgugcaccguggugaugaccgacggcuccgccagcgagcgggcggacaccaagauccuguucaucgaggaggggaagaucguccacaucucgccccuguccggcagcgcccagcacguggaggagugcuccugcuacccccgcuacccgggggugcggugcgucugccgcgacaacuggaagggcucgaaccggcccaucguggacaucaacgugaaggacuacuccaucgucagcuccuacgugugcucgggccucgugggggacacgccccgcaagaacgacuccagcuccucguccuacugccggaaccccaacaacgagaagggcagccacggggucaagggcugggccuucgacgacgggaacgacguguggaugggccgcaccaucuccgaggagcugcggucgggcuacgagaccuuccgcgucaucgggggcugguccaagccgaacagcaagcugcagaucaaccgccaggugaucguggaccgggggaaccgguccggcuacucggggaucuucagcgucgagggcaaguccugcaucaaccgcugcuucuacguggagcucauccgcggccggaagcaggagaccgaggugugguggacgucgaacuccaucgucguguucugcgggaccagcggcaccuacgggaccggcuccuggcccgacggggccgacaucaaccugaugcccaucuga

SEQ ID NO: 24336 - RNA, 1410 nt, Artificial Sequence; identical to SEQ ID NO: 17587
  derived and/or modified CDS sequence (AUadapt) from InfluenzaA__AFG72320__NA

SEQ ID NO: 24337 - RNA, 1410 nt, Artificial Sequence
  derived and/or modified CDS sequence (AUadapt) from InfluenzaA__AFG72331__NA
augaaccccaaccagaagaucaucaccaucggcucggugucccugaccgucgccacgaucugcuuccucaugcagaucgccauccuggugaccaccgugacccugcacuucaagcaguacgagugcaacucgccgcccaacaaccaggucaugcucugcgagcccacgaucaucgagcgcaacaucaccgagaucguguaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacgucuccugcgaccccggcaagugcuaccaguucgcccuggggcagggcaccacgcugaacaaccgccacagcaacgacaccgugcacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcuggucgacucgaucggguccuggucgaagaacauccuccgcacccaggaguccgagugcgugugcaucaacggcacgugcaccguggucaugaccgacggcagcgccuccgagcgggcggacaccaagauccuguucaucgaggaggggaagaucgugcacaucucgccccugagcggcuccgcccagcacguggaggagugcucgugcuacccccgcuacccggggguccggugcgugugccgcgacaacuggaagggcuccaaccggcccaucguggacaucaacgucaaggacuacagcaucguguccucguacgugugcuccggccucgucggggacacgccccgcaagaacgacagcuccucguccucguacugccggaaccccaacaacgagaagggcucccacggggugaagggcugggccuucgacgacgggaacgacgucuggaugggccgcaccaucagcgaggagcugcgguccggcuacgagaccuucaaggugaucgggggcuggucgaagccgaacuccaagcugcagaucaaccgccaggugaucgucgaccgggggaaccgcagcggcuacuccgggaucuucucgguggagggcaagagcugcaucaaccggugcuucuacguggagcucauccgcggccgcaagcaggagaccgaggucugguggacguccaacucgaucgugguguucugcgggaccuccggcaccuacgggaccggcagcuggcccgacggggccgacaucaaccugaugcccaucuga

SEQ ID NO: 24338 - RNA, 1410 nt, Artificial Sequence
  derived and/or modified CDS sequence (AUadapt) from InfluenzaA__AFG72353__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgacagcggcaagugcuaccaguucgcccuggggcagggcaccacgcugaacaaccgccacuccaacgacaccguccacgaccggacccccuaccgcacccuccugaugaacgagcugggcgugccguuccaccucgggacgaagcaggucugcaucgccuggucguccagcuccugccacgacggcaaggcguggcugcacgugugcgugaccgggcacgacgagaacgccaccgccucguucaucuacgacggccggcugguggacuccaucgggagcugguccaagaacauccuccgcacccaggagucggagugcgucugcaucaacggcacgugcaccguggugaugaccgacggcuccgccagcgagcgggcggacaccaagauccuguucaucgaggaggggaagaucguccacaucucgccccuguccggcagcgcccagcacguggaggagugcuccugcuacccccgcuaccccggggugcggugcgucugccgcgacaacuggaagggcucgaaccggccgaucguggacaucaacgugaaggacuacuccaucgucagcuccuacgugugcucgggccucgugggggacacgccccgcaagaacgacuccagcuccucguccuacugccggaaccccaacaacgagaagggcagccacggggucaagggcugggccuucgacgacgggaacgacguguggaugggccgcaccaucuccgaggagcugcggucgggcuacgagaccuucaaggucaucgggggcugguccaagcccaacagcaagcugcagaucaaccgccaggugaucguggaccgggggaaccgcuccggcuacucggggaucuucagcgucgagggcaaguccugcaucaaccggugcuucuacguggagcucauccgcggccgcaagcaggagaccgaggugugguggacgucgaacuccaucgucguguucugcgggaccagcggcaccuacgggaccggcuccuggccggacggggccgacaucaaccugaugcccaucuga

SEQ ID NO: 24339 - RNA, 1410 nt, Artificial Sequence; identical to SEQ ID NO: 17587
  derived and/or modified CDS sequence (AUadapt) from InfluenzaA__AFG72364__NA

SEQ ID NO: 24340 - RNA, 1410 nt, Artificial Sequence
  derived and/or modified CDS sequence (AUadapt) from InfluenzaA__AFG72430__NA
augaaccccaaccagaagaucaucaccaucggcucggugucccugaccaucacgaccaucugcuuccucaugcagaucgccauccuggucaucaccgugacccugcacuucaagcagugcgagugcaacucgccgcccaacaaccaggugaugcucugcgagcccacgaucaucgagcgcaacaucaccgagaucgucuaccugaccaacaccacgaucgagaaggagaucugccccaagcuggccgaguaccggaacugguccaagccgcagugcaagaucaccggguucgcgcccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggccuggcugcacgugugcgugaccgggcacaacgagaacgcgaccgccuccuucaucuacgacggccggcugguggacucgaucggguccuggagcaagaacauccuccgcacccaggaguccgagugcgucugcaucaacggcacgugcaccguggugaugaccgacggcucggccuccgggcgggccgacaccaagauccuguucaucgaggagggcaagaucguccacaucagccagcugucgggguccgcgcagcacguggaggagugcucgugcuacccccgcuaccccggcgugcggugcgucugccgcgacaacuggaagggcuccaaccggccgaucguggacaucaacgugaaggacuacagcaucgucuccucguacgugugcuccgggcucgugggcgacacgccccgcaagaacgacagcuccucguccagcaacugccuggaccccaacaacgaggagggcgggcacggggucaagggcugggccuucgacgacggcaacgacguguggauggggcggaccaucuccgagaagcugcgcucgggcuacgagaccuucaaggucaucgggggcugguccaagcccaacagcaagcuccagaucaaccgccaggugaucguggaccgggggaaccgguccggcuacucgggcaucuucuccgucgagggcaagagcugcaucaaccgcugcuucuacguggagcugauccgggggcgcaagcaggagaccgaggugugguggacgucgaacuccaucgucguguucugcgggaccagcggcaccuacgggaccggcuccuggccggacggcgccgacaucaaccugaugcccaucuga

SEQ ID NO: 24341 - RNA, 1410 nt, Artificial Sequence; identical to SEQ ID NO: 17587
  derived and/or modified CDS sequence (AUadapt) from InfluenzaA__AFG72452__NA

SEQ ID NO: 24342 - RNA, 1410 nt, Artificial Sequence
  derived and/or modified CDS sequence (AUadapt) from InfluenzaA__AFG72474__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcgagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggucgaagaacauccuccgcacccaggaguccgagugcgucugcaucaacggcacgugcaccguggugaugaccgacggcagcgccuccgagcgggcggacaccaagauccuguucaucgaggaggggaagaucguccacaucucgccccugagcggcuccgcccagcacguggaggagugcucgugcuacccccgcuacccgggggugcggugcgucugccgcgacaacuggaagggcuccaaccggcccaucguggacaucaacgugaaggacuacagcaucgucuccucguacgugugcuccggccucgugggggacacgccccgcaagaacgacagcuccucguccucguacugccggaaccccaacaacgagaagggcucccacggggucaagggcugggccuucgacgacgggaacgacguguggaugggccgcaccaucagcgaggagcugcgguccggcuacgagaccuucaaggucaucgggggcuggucgaagccgaacuccaagcugcagaucaaccgccaggugaucguggaccgggggaaccgcagcggcuacuccgggaucuucucggucgagggcaagagcugcaucaaccggugcuucuacguggagcucauccgcggccgcaagcaggagaccgaggugugguggacguccaacucgaucgucguguucugcgggaccuccggcaccuacgggaccggcagcuggcccgacggggccgacaucaaccugaugcccaucuga

SEQ ID NO: 24343 - RNA, 1410 nt, Artificial Sequence
  derived and/or modified CDS sequence (AUadapt) from InfluenzaA__AFG72485__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccucgugccacgacggcaaggcguggcugcacgugugcgugaccgggcacgacgagaacgccaccgccuccuucaucuacgacggccggcugguggacagcaucggguccuggucgaagaacauccuccgcacccaggaguccgagugcgucugcaucaacggcacgugcaccguggugaugaccgacggcagcgccuccgagcgggcggacaccaagauccuguucaucgaggaggggaagaucguccacaucucgccccugucgggcuccgcccagcacguggaggagugcagcugcuacccccgcuacccgggggugcggugcgucugccgcgacaacuggaagggcuccaaccggcccaucguggacaucaacgugaaggacuacucgaucgucuccagcuacgugugcuccggccucgugggggacacgccccgcaagaacgacucguccucguccagcuacugccggaaccccaacaacgagaagggcucccacggggucaagggcugggccuucgacgacgggaacgacguguggaugggccgcaccaucucggaggagcugcgguccggcuacgagaccuucaaggucaucgggggcuggagcaagccgaacuccaagcugcagaucaaccgccaggugaucguggaccgggggaaccgcucgggcuacuccgggaucuucucggucgagggcaagagcugcaucaaccggugcuucuacguggagcucauccgcggccgcaagcaggagaccgaggugugguggacguccaacucgaucgucguguucugcgggaccuccggcaccuacgggaccggcagcuggcccgacggggccgacaucaaccugaugcccaucuga

SEQ ID NO: 24344 - RNA, 1410 nt, Artificial Sequence; identical to SEQ ID NO: 17503
  derived and/or modified CDS sequence (AUadapt) from InfluenzaA__AFG72507__NA

SEQ ID NO: 24345 - RNA, 1410 nt, Artificial Sequence
  derived and/or modified CDS sequence (AUadapt) from InfluenzaA__AFG72529__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggucgaagaagauccuccgcacccaggaguccgagugcgucugcaucaacggcacgugcaccguggugaugaccgacggcagcgccuccgagcgggcggacaccaagauccuguucaucgaggaggggaagaucguccacaucucgccccugagcggcuccgcccagcacguggaggagugcucgugcuacccccgcuacccgggggugcggugcgucugccgcgacaacuggaagggcuccaaccggcccaucguggacaucaacgugaaggacuacagcaucgucuccucguacgugugcuccggccucgugggggacacgccccgcaagaacgacagcuccucguccucguacugccagaaccccaacaacgagaacggcucccacggggucaagggcugggccuucgacgacgggaacgacguguggaugggccggaccaucagcgaggagcugcgcuccggcuacgagaccuucaaggucaucgggggcuggucgaagccgaacuccaagcugcagaucaaccgccaggugaucguggaccgggggaaccggagcggcuacuccgggaucuucucggucgagggcaagagcugcaucaaccgcugcuucuacguggagcucauccggggccgcaagcaggagaccgaggugugguggacguccaacucgaucgucguguucugcgggaccuccggcaccuacgggaccggcagcuggcccgacggggccgacaucaaccugaugcccaucuga

SEQ ID NO: 24346 - RNA, 1410 nt, Artificial Sequence
  derived and/or modified CDS sequence (AUadapt) from InfluenzaA__AFG72540__NA
augaaccccaaccagaagaucaucaccaucggcucggugucccugaccaucgccacgaucugcuuccucaugcagaucgccauccuggucaccaccgugacccugcacuucaagcaguacgagugcaacccgccgcccaacaaccaggugaugcucugcgagcccacgaucaucgagcgcaacaucaccgagaucgucuaccugaccaacaccacgaucaagaaggagaucugccccaagcuggcggaguaccggaacuggucgaagccccagugcaagaucaccggguucgcccccuucuccaaggacaacagcauccgccucuccgccggcggggacaucugggugacccgggagcccuacgugucgugcgacccgggcaagugcuaccaguucgcccuggggcagggcaccacgcugaacaaccgccacuccaacgacaccguccacgaccggacccccuaccgcacccuccugaugaacgagcugggcgugcccuuccaccucgggacgaagcaggucugcaucgccuggagcuccucguccugccacgacggcaaggcguggcugcacgugugcgugaccgggcacgacgagaacgccaccgccucguucaucuacgacggccggcugguggacuccaucgggagcugguccaagaacauccuccgcacccaggagucggagugcgucugcaucaacggcacgugcaccguggugaugaccgacggcuccgccagcgagcgggcggacaccaagauccuguucaucgaggaggggaagaucguccacaucucgccccuguccggcagcgcccagcacguggaggagugcuccugcuacccgcgcuaccccggggugcggugcgucugccgcgacaacuggaagggcucgaaccggcccaucguggacaucaacgugaaggacuacuccaucgucucguccuacgugugcagcggccucgugggggacacgccccgcaagaacgacuccucguccagcuccuacugcuggaacccgaacaacgagaagggcgggcacggcgucaaggggugggccuucgacgacggcaacgacguguggaugggccggaccaucucggaggagcugcgcuccggguacgagaccuucaaggucaucggcggguggucgaagcccaacuccaagcugcagaucaaccgccaggugaucguggaccggggcaaccggagcggguacuccggcaucuucucggucgagggcaaguccugcaucaaccgcugcuucuacguggagcucauccgggggcgcaagcaggagaccgaggugugguggacgagcaacucgaucgucguguucugcggcaccuccgggaccuacggcaccgggagcuggcccgacggcgccgacaucaaccugaugcccaucuga

SEQ ID NO: 24347 - RNA, 1410 nt, Artificial Sequence
  derived and/or modified CDS sequence (AUadapt) from InfluenzaA__AFG72562__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggagcaagaacauccuccgcacccaggaguccgagugcgucugcaucaacggcacgugcaccguggugaugaccgacggcucggccuccgagcgggcggacaccaagauccuguucaucgaggaggggaagaucguccacaucagcccccugucgggcuccgcccagcacguggaggagugcucgugcuacccccgcuacccgggggugcggugcgucugccgcgacaacuggaagggcuccaaccggcccaucguggacaucaacgugaaggacuacagcaucgucuccucguacgugugcuccggccucgugggggacacgccccgcaagaacgacagcuccucguccagcuacugcuggaaccccaacaacgagaagggcgggcacggcgucaaggggugggccuucgacgacggcaacgacguguggaugggccggaccaucuccgaggagcugcgcucgggguacgagaccuucaaggucaucggcgggugguccaagccgaacagcaagcugcagaucaaccgccaggugaucguggaccggggcaaccgguccggguacucgggcaucuucuccgucgagggcaagagcugcaucaaccgcugcuucuacguggagcucauccgggggcgcaagcaggagaccgaggugugguggacgucgaacuccaucgucguguucugcggcaccagcgggaccuacggcaccggguccuggcccgacggcgccgacaucaaccugaugcccaucuga

SEQ ID NO: 24348 - RNA, 1410 nt, Artificial Sequence
  derived and/or modified CDS sequence (AUadapt) from InfluenzaA__AFG72584__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggaggugugccccaagcuggcggaguaccggaacugguccaagccgcagugcaagaucaccggguucgcccccuucagcaaggacaacuccauccgccucucggccggcggggacaucugggugacccgggagcccuacgucuccugcgaccccggcaagugcuaccaguucgcccuggggcagggcaccacgcugaacaacaagcacagcaacgacaccgugcacgaccgcaccccguaccggacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccgccuggucgacucgaucggguccuggagcaagaacauccuccggacccaggaguccgagugcgugugcaucaacggcacgugcaccguggucaugaccgacggcucggccuccgagaaggcggacaccaagauccuguucaucgaggaggggaagaucgugcacaucagcccccugucgggcuccgcccagcacguggaggagugcucgugcuacccccgcuacccggggguccggugcgugugccgcgacaacuggaagggcuccaaccggcccaucguggacaucaacgucaaggacuacagcaucguguccucguacgugugcuccggccucgucggggacacgccccgcaagaacgacagcuccucguccagcuacugcuggaaccccaacaacgagaagggcgggcacggcgugaaggggugggccuucgacgacggcaacgacgucuggaugggccggaccaucuccgaggagcugcgcucgggguacgagaccuucaaggugaucggcgggugguccaagccgaacagcaagcugcagaucaaccgccaggugaucgucgaccggggcaaccgguccggguacucgggcaucuucuccguggagggcaagagcugcaucaaccgcugcuucuacguggagcucauccgggggcgcaagcaggagaccgaggucugguggacgucgaacuccaucgugguguucugcggcaccagcgggaccuacggcaccggguccuggcccgacggcgccgacaucaaccugaugcccaucuga

SEQ ID NO: 24349 - RNA, 1410 nt, Artificial Sequence
  derived and/or modified CDS sequence (AUadapt) from InfluenzaA__AFG72606__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccucgugccacgacggcaaggcguggcugcacgugugcgugaccgggcacgacgagaacgccaccgccuccuucaucuacgacggccggcugguggacagcaucggguccuggucgaagaacauccuccgcacccaggaguccgagugcgucugcaucaacggcacgugcaccguggugaugaccgacggcagcgccuccgagcgggcggacaccaagauccuguucaucgaggaggggaagaucguccacaucucgccccugagcggcuccgcccagcacguggaggagugcucgugcuacccccgcuacccgggggugcggugcgucugccgcgacaacuggaagggcuccaaccggcccaucguggacaucaacgugaaggaccacucgaucgucuccagcuacgugugcuccggccucgugggggacacgccccgcaagaacgacucguccagcuccucguacugccugaaccccaacaacgaggagggcgggcacggcgucaaggggugggccuucgacgacggcaacgacguguggaugggccggaccaucuccgagaagcugcgcucgggguacgagaccuucaaggucaucggcgggugguccaagccgaacagcaagcuccagaucaaccgccaggugaucguggaccggggcaaccgguccggguacucgggcaucuucuccgucgagggcaagagcugcgugaaccgcugcuucuacguggagcugauccgggggcgcaagcaggagaccgaggucugguggacgucgaacuccaucgugguguucugcggcaccagcgggaccuacggcaccggguccuggcccgacggcgccgacaucaaccugaugcccaucuga

SEQ ID NO: 24350 - RNA, 1410 nt, Artificial Sequence
  derived and/or modified CDS sequence (AUadapt) from InfluenzaA__AFG72617__NA
augaaccccaaccagaagaucaucaccaucggcucggugucccugaccaucacgaccaucugcuuccucaugcagaucgccauccuggucaucaccgugacccugcacuucaagcagugcgagugcaacagcccgcccaacaaccaggugaugcucugcgagcccacgaucaucgagcgcaacaucaccgagaucgucuaccugaccaacaccacgaucgagaaggagaucugccccaagcuggccgaguaccggaacugguccaagccgcagugcaagaucaccggguucgcgcccuucucgaaggacaacuccauccgccucagcgccggcggggacaucugggugacccgggagcccuacguguccugcgaccccggcaagugcuaccaguucgcccuggggcagggcaccacgcugaacaaccgccacucgaacgacaccguccacgaccggaccccguaccgcacccuccugaugaacgagcugggcgugcccuuccaccucgggacgaagcaggucugcaucgccugguccagcuccucgugccacgacggcaaggccuggcugcacgugugcgugaccgggcacaacgagaacgcgaccgccuccuucaucuacgacggccggcugguggacagcaucggguccuggucgaagaacauccuccgcacccaggaguccgagugcgucugcaucaacggcacgugcaccguggugaugaccgacggcagcgccuccgggcgggccgacaccaagauccuguucaucgaggagggcaagaucguccacaucucgccccugagcggguccgcgcagcacguggaggagugcucgugcuacccccgcuacccgggcgugcggugcgucugccgcgacaacuggaagggcuccaaccggcccaucguggacaucaacgugaaggacuacagcaucgucuccucguacgugugcuccgggcucgugggcgacacgccccgcaagaacgacagcuccucguccagcuacugccugaaccccaacaacgaggagggcgggcacggggucaagggcugggccuucgacgacggcaacgacguguggauggggcggaccaucuccgagaagcugcgcucgggcuacgagaccuucaaggucaucgggggcugguccaagccgaacagcaagcuccagaucaaccgccaggugaucguggaccgggggaaccgguccggcuacucgggcaucuucuccgucgagggcaagagcugcaucaaccgcugcuucuacguggagcugauccgggggcgcaagcaggagaccgaggugugguggacgucgaacuccaucgucguguucugcgggaccagcggcaccuacgggaccggcuccuggcccgacggcgccgacaucaaccugaugcccaucuga

SEQ ID NO: 24351 - RNA, 1410 nt, Artificial Sequence
  derived and/or modified CDS sequence (AUadapt) from InfluenzaA__AFG72628__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccucguccagcugccacgacgggaaggcguggcugcacgugugcgugaccggccacgacgagaacgccaccgccuccuucaucuacgacgggcggcugguggacucgaucggcuccuggucgaagaagauccuccgcacccaggaguccgagugcgucugcaucaacgggacgugcaccguggugaugaccgacggcagcgccuccggccgggcggacaccaagauccuguucaucgaggaggggaagaucguccacaucucgccccugagcggcuccgcccagcacguggaggagugcucgugcuacccccgcuacuccggggugcggugcgucugccgcgacaacuggaagggcagcaaccggccgaucguggacaucaacgugaaggacuacuccaucgucucguccuacgugugcagcggccucgugggggacacgccccgcaagaacgacuccucguccucgucccacugccugaaccccaacaacgaggagggcgggcacggcgucaaggggugggccuucgacgacggcaacgacguguggaugggccggaccaucagcgagaagcugcgcuccggguacgagaccuucaaggucaucggcggguggucgaagcccaacuccaagcuccagaucaaccgccaggugaucguggaccggggcaaccggagcggguacuccggcaucuucucggucgagggcaagagcugcaucaaccgcugcuucuacguggagcugauccgggggcgcaagcaggagaccgaggugugguggacguccaacucgaucgucguguucugcggcaccuccgggaccuacggcaccgggagcuggccggacggcgccgacaucaaccugaugcccaucuga

SEQ ID NO: 24352 - RNA, 1410 nt, Artificial Sequence; identical to SEQ ID NO: 17382
  derived and/or modified CDS sequence (AUadapt) from InfluenzaA__AFG72639__NA

SEQ ID NO: 24353 - RNA, 1410 nt, Artificial Sequence
  derived and/or modified CDS sequence (AUadapt) from InfluenzaA__AFG72650__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggagcaagaacauccuccgcacccaggaguccgagugcgucugcaucaacggcacgugcaccguggugaugaccgacggcucggccuccgagcgggcggacaccaagauccuguucaucgaggaggggaagaucguccacaucagcccccugucgggcuccgcccagcacguggaggagugcucgugcuacccccgcuacccgggggugcggugcgucugccgcgacaacuggaagggcuccaaccggcccaucguggacaucaacgugaaggacuacagcaucgucuccucguacgugugcuccggccucgugggggacacgccccgcaagaacgacagcuccucguccagcuacugccugaaccccaacaacgaggagggcgggcacggcgucaaggggugggccuucgacgacggcaacgacguguggaugggccggaccaucuccgagaagcugcgcucgggguacgagaccuucaaggucaucggcgggugguccaagccgaacagcaagcuccagaucaaccgccaggugaucguggaccggggcaaccgguccggguacucgggcaucuucuccgucgagggcaagagcugcgugaaccgcugcuucuacguggagcugauccgggggcgcaagcaggagaccgaggucugguggacgucgaacuccaucgugguguucugcggcaccagcgggaccuacggcaccggguccuggcccgacggcgccgacaucaaccugaugcccaucuga

SEQ ID NO: 24354 - RNA, 1410 nt, Artificial Sequence; identical to SEQ ID NO: 24351
  derived and/or modified CDS sequence (AUadapt) from InfluenzaA__AFG72672__NA

SEQ ID NO: 24355 - RNA, 1407 nt, Artificial Sequence
  derived and/or modified CDS sequence (AUadapt) from InfluenzaA__AFG72683__NA
augaaccccaaccagaagaucaucaccaucggcucggugucccugaccaucgccacgaucugcuuccucaugcagaucgccauccuggucaucaccgugacccugcacuucaagcaguacgagugcaacucgccgcccaacaaccaggugaugcucugcgagcccaccaucaucgagcgcaacaucacggagaucgucuaccugaccaacaccaccaucgagaaggagaucugccccaagcuggcggaguaccggaacugguccaagccgcagugcaagaucacgggguucgcccccuucagcaaggacaacuccauccgccucucggccggcggggacaucugggugacccgggagcccuacguguccugcgaccccggcaagugcuaccaguucgcccuggggcagggcaccacccugaacaaccgccacagcaacgagguccacgaccggacgccguaccgcacccuccugaugaacgagcugggcgugcccuuccaccucgggaccaagcaggucugcaucgccugguccucguccagcugccacgacggcaaggcguggcugcacgugugcgugaccgggcacaacgagaacgccacggccuccuucaucuacgacggccggcugguggacucgaucggguccuggagcaagaacauccuccgcacccaggaguccgagugcgucugcaucaacgggaccugcaccguggugaugacggacggcucggccuccgggcgggcggacaccaagauccuguucaucgaggagggcaagaucguccacaucagcccccugucgggguccgcccagcacguggaggagugcucgugcuacccccgcuacccgggcgugcggugcgucugccgcgacaacuggaagggcuccaaccggcccaucguggacaucaacgugaaggacuacagcaucgucuccucguacgugugcuccgggcucgugggcgacacgccccgcaagaacgacagcuccucguccagccacugccugaaccccaacaacgaggagggcggccacggggucaagggcugggccuucgacgacggcaacgacguguggauggggcggaccaucuccgagaagcugcgcucgggcuacgagaccuucaaggucaucgggggcugguccaagccgaacagcaagcuccagaucaaccgccaggugaucguggaccgggggaaccgguccggcuacucgggcaucuucuccgucgagggcaagagcugcaucaaccgcugcuucuacguggagcugauccgggggcgcaagcaggagaccgaggugugguggaccucgaacuccaucgucguguucugcgggaccagcggcacguacgggaccggcuccuggcccgacggcgccgacaucaaccugaugcccaucuga

SEQ ID NO: 24356 - RNA, 1410 nt, Artificial Sequence
  derived and/or modified CDS sequence (AUadapt) from InfluenzaA__AFG72705__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccaggggaccacgcugaacaaccgccacucgaacgacaccguccacgaccggaccccguaccgcacccuccugaugaacgagcugggcgugcccuuccaccucggcacgaagcaggucugcaucgccugguccagcuccucgugccacgacgggaaggcguggcugcacgugugcgugaccggccacgacgagaacgccaccgccuccuucaucuacgacgggcggcugguggacagcaucggcuccuggucgaagaagauccuccgcacccaggaguccgagugcgucugcaucaacgggacgugcaccguggugaugaccgacggcucggccuccggccgggcggacaccaagauccuguucaucgaggaggggaagaucguccacaucagccagcugucgggcuccgcccagcacguggaggagugcucgugcuacccccgcuaccccggggugcggugcgucugccgcgacaacuggaagggcuccaaccggccgaucguggacaucaacgugaaggaccacagcaucgucuccucguacgugugcuccggccucgugggggacacgccccgcaagaacgacagcuccucguccucgcacugccugaaccccaacaacgaggagggcgggcacggcgucaaggggugggccuucgacgacggcaacgacguguggaugggccggaccaucuccgagaagcugcgcagcggguacgagaccuucaaggucaucgagggcugguccaagcccaacucgaagcuccagaucaaccgccaggugaucguggaccgggggaaccgguccggcuacucggggaucuucuccgucgagggcaagagcugcaucaaccgcugcuucuacguggagcugauccggggccgcaagcaggagaccgaggugugguggacgucgaacuccaucgucguguucugcgggaccagcggcaccuacgggaccggcuccuggccggacggggccgacaucaaccugaugcccaucuga

SEQ ID NO: 24357 - RNA, 1410 nt, Artificial Sequence
  derived and/or modified CDS sequence (AUadapt) from InfluenzaA__AFG72716__NA
augaaccccaaccagaagaucaucaccaucggcucggugucccugaccaucacgaccaucugcuuccucaugcagaucgccauccuggucaucaccgugacccugcacuucaagcagugcgagugcaacucgccgcccaacaaccaggugaugcucugcgagcccacgaucaucgagcgcaacaucaccgagaucgucuaccugaccaacaccacgaucgagaaggagaucugccccaagcuggccgaguaccggaacugguccaagccgcagugcaagaucaccggguucgcgcccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggccuggcugcacgugugcgugaccgggcacaacgagaacgcgaccgccuccuucaucuacgacggccggcugguggacucgaucggguccuggagcaagaacauccuccgcacccaggaguccgagugcgucugcaucaacggcacgugcaccguggugaugaccgacggcucggccuccgggcgggccgacaccaagauccuguucaucgaggagggcaagaucguccacaucagcccccugucgggguccgcgcagcacguggaggagugcagcugcuacccccgcuacccgggcgugcggugcgucugccgcgacaacuggaagggcuccaaccggcccaucguggacaucaacgugaaggacuacucgaucgucuccagcuacgugugcuccgggcucgugggcgacacgccccgcaagaacgacucguccagcuccucguacugccuggaccccaacaacgaggagggcgggcacggggucaagggcugggccuucgacgacggcaacgacguguggauggggcggaccaucuccgagaagucccgcagcggcuacgagaccuucaaggucaucgggggcuggucgaagccgaacuccaagcugcagaucaaccgccaggugaucguggaccgggggaaccggagcggcuacuccggcaucuucucggucgagggcaagagcugcaucaaccgcugcuucuacguggagcucauccgggggcgccgccaggagaccgaggugugguggacguccaacucgaucgucguguucugcgggaccuccggcaccuacgggaccggcagcuggcccgacggcgccgacaucaaccugaugcccaucuga

SEQ ID NO: 24358 - RNA, 1410 nt, Artificial Sequence
  derived and/or modified CDS sequence (AUadapt) from InfluenzaA__AFG72738__NA
augaaccccaaccagaagaucaucaccaucggcucggugucccugaccaucacgaccaucugcuuccucaugcagaucgccauccuggucaucaccgugacccugcacuucaagcagugcgagugcaacagcccgcccaacaaccaggugaugcucugcgagcccacgaucaucgagcgcaacaucaccgagaucgucuaccugaccaacaccacgaucgagaaggagaucugccccaagcuggccgaguaccggaacugguccaagccgcagugcaagaucaccggguucgcgcccuucucgaaggacaacuccauccgccucagcgccggcggggacaucugggugacccgggagcccuacguguccugcgaccccggcaagugcuaccaguucgcccuggggcagggcaccacgcugaacaaccgccacucgaacgacaccguccacgaccggaccccguaccgcacccuccugaugaacgagcugggcgugcccuuccaccucgggacgaagcaggucugcaucgccugguccagcuccucgugccacgacggcaaggccuggcugcacgugugcgugaccgggcacaacgagaacgcgaccgccuccuucaucuacgacggccggcugguggacagcaucggguccuggucgaagaacauccuccgcacccaggaguccgagugcgucugcaucaacggcacgugcaccguggugaugaccgacggcagcgccuccgggcgggccgacaccaagauccuguucaucgaggagggcaagaucguccacaucucgcagcugagcggguccgcgcagcacguggaggagugcucgugcuacccccgcuaccccggcgugcggugcgucugccgcgacaacuggaagggcuccaaccggccgaucguggacaucaacgugaaggacuacagcaucgucuccucguacgugugcuccgggcucgugggcgacacgccccgcaagaacgacagcuccucguccagcuacugccuggaccccaacaacgaggagggcgggcacggggucaagggcugggccuucgacgacggcaacgacguguggauggggcggaccaucuccgagaagcugcgcucgggcuacgagaccuucaaggucaucgggggcugguccaagcccaacagcaagcuccagaucaaccgccaggugaucguggaccgggggaaccgguccggcuacucgggcaucuucuccgucgagggcaagagcugcaucaaccgcugcuucuacguggagcugauccgggggcgcaagcaggagaccgaggugugguggacgucgaacuccaucgucguguucugcgggaccagcggcaccuacgggaccggcuccuggccggacggcgccgacaucaaccugaugcccaucuga

SEQ ID NO: 24359 - RNA, 1410 nt, Artificial Sequence; identical to SEQ ID NO: 17587
  derived and/or modified CDS sequence (AUadapt) from InfluenzaA__AFG72749__NA

SEQ ID NO: 24360 - RNA, 1410 nt, Artificial Sequence; identical to SEQ ID NO: 16975
  derived and/or modified CDS sequence (AUadapt) from InfluenzaA__AFG72760__NA

SEQ ID NO: 24361 - RNA, 1410 nt, Artificial Sequence; identical to SEQ ID NO: 16442
  derived and/or modified CDS sequence (AUadapt) from InfluenzaA__AFG72771__NA

SEQ ID NO: 24362 - RNA, 1410 nt, Artificial Sequence
  derived and/or modified CDS sequence (AUadapt) from InfluenzaA__AFG72782__NA
augaaccccaaccagaagaucaucaccaucggcucggugucccugaccaucgccacgaucugcuuccucaugcagaucgccauccuggucaccaccgugacccugcacuucaagcaguacgagugcaacucgcucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucagcaaggacaacuccauccgccugucggccggcggggacaucugggugacccgggagcccuacguguccugcgaccccgacaagugcuaccaguucgcccugggccaggggaccacgcucaacaaccgccacagcaacgacaccguccacgaccggacccccuaccgcacccugcugaugaacgagcucggcgugccguuccaccugggcacgaagcaggucugcaucgccugguccucguccagcugccacgacgggaaggcguggcugcacgugugcgugaccggccacgacgagaacgccaccgccuccuucaucuacgacgggcggcucguggacucgaucggcuccuggagcaagaagauccugcgcacccaggaguccgagugcgucugcaucaacgggacgugcaccguggugaugaccgacggcucggccuccggccgggcggacaccaagauccuguucaucgaggaggggaagaucauccacacgagccagcucucgggcuccgcccagcacgucgaggagugcucgugcuacccccgcuaccccggggugcggugcgugugccgcgacaacuggaagggcuccaaccggcccaucgucgacaucaacgugaaggacuacagcaucguguccucguacgucugcuccggccuggugggggacaccccgcgcaagaacgacagcuccucguccagccacugccugaaccccaacaacgaggagggcgggcacggcgugaaggggugggccuucgacgacggcaacgacgucuggaugggccggaccaucuccgagaaguuccgcucgggguacgagaccuucaaggugaucgagggcugguccaagcccaacagcaagcuccagaucaaccggcaggucaucguggaccgcgacaaccgguccggguacucgggcaucuucuccguggagggcaagagcugcaucaaccgcugcuucuacgucgagcugauccgggggcgcaagcaggagacggaggugugguggaccucgaacuccaucguggucuucugcggcaccagcgggaccuacggcacgggguccuggcccgacggcgccgacaucaaccugaugccgaucuga

SEQ ID NO: 24363 - RNA, 1410 nt, Artificial Sequence; identical to SEQ ID NO: 18151
  derived and/or modified CDS sequence (AUadapt) from InfluenzaA__AFG72793__NA

SEQ ID NO: 24364 - RNA, 1410 nt, Artificial Sequence; identical to SEQ ID NO: 16686
  derived and/or modified CDS sequence (AUadapt) from InfluenzaA__AFG72804__NA

SEQ ID NO: 24365 - RNA, 1410 nt, Artificial Sequence; identical to SEQ ID NO: 18331
  derived and/or modified CDS sequence (AUadapt) from InfluenzaA__AFG72826__NA

SEQ ID NO: 24366 - RNA, 1410 nt, Artificial Sequence
  derived and/or modified CDS sequence (AUadapt) from InfluenzaA__AFG72837__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgagcgcaccccguaccggacccuccugaugaacgagcugggcgugcccuuccaccucgggacgaagcaggucugcaucgccugguccucguccagcugccacgacggcaaggcguggcugcacgugugcgugaccggggacgacgagaacgccaccgccuccuucaucuacaacggccgccugguggacucgaucggguccuggagcaagaagauccuccggacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgcuaccccggcgugcggugcgucugccgcgacaacuggaagggcuccaaccggccgaucguggacaucaacgugaaggacuacagcaucgucuccucguacgugugcuccgggcucgugggcgacacgccccgcaagaacgacagcuucuccucgucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggucgaagcccaacuccaagcuccagaucaaccgccaggugaucguggagcggggcaaccggagcggguacuccggcaucuucucggucgagggcaaguccugcaucaaccgcugcuucuacguggagcugauccgggggcgcaaggaggagaccgaggugugguggaccagcaacucgaucgucguguucugcggcaccuccgggaccuacggcacggggagcuggccggacggcgccgacaucaaccugaugcccaucuga

SEQ ID NO: 24367 - RNA, 1413 nt, Artificial Sequence
  derived and/or modified CDS sequence (AUadapt) from InfluenzaA__AFG72848__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaaguccgcggaguaccggaacuggagcaagccgcagugcaacaucaccggguucgcccccuucuccaaggacaacucgauccgccuguccgccggcggggacaucugggugacccgggagcccuacgugagcugcgaccccgacaagugcuaccaguucgcccucggccaggggaccacgcugaacaacggccacuccaacgacaccguccacgaccgcaccccguaccggacccugcucaugaacgagcugggcgugcccuuccaccuggggacgcgccaggugugcaucgccuggucguccagcuccugccacgacggcaaggcguggcuccacgucugcgugaccggggacgacaagaacgccaccgccucguucaucuacaacggccggcugguggacuccaucgggucgugguccaagaaguacauccugcgcacccaggagagcgagugcgucugcaucaacggcacgugcaccguggugaugaccgacggcuccgccucggggaaggcggacaccaagauccucuucaucgaggagggcaagaucauccacaucagcacgcuguccgggucggcccagcacgucgaggagugcuccugcuacccccgguaccccggcgugcgcugcgugugccgggacaacuggaagggcagcaaccgcccgaucgucgacaucaacgugaaggacuacuccaucgugucguccuacgucugcagcgggcuggugggcgacacgccccggaagaacgacuccucguccucgucccacugccucgaccccaacaacgaggagggcgggcacggggugaagggcugggccuucgacgacggcaacgacgucuggauggggcgcaccaucagcgagaagcugcgguccggcuacgagaccuucaaggugaucgagggguggucgaagcccaacuccaagcugcagaucaaccgccaggucaucguggagcggggcaaccgcagcggguacuccggcaucuucucgguggagggcaagagcugcaucaaccggugcuucuacgucgagcucauccgcgggcggaaggaggagaccgaggugugguggaccuccaacucgaucguggucuucugcggcaccuccgggaccuacggcacggggagcuggccggacggcgccgacaucaaccugaugcccaucuga

SEQ ID NO: 24368 - RNA, 1410 nt, Artificial Sequence
  derived and/or modified CDS sequence (AUadapt) from InfluenzaA__AFG72859__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaucguccacgaccgcaccccguaccggacccugcucaugaacgagcugggcgugcccuuccaccugggcaccaagcaggucugcaucgccuggucguccagcuccugccacgacgggaaggccuggcuccacgugugcgugacgggcgacgacgagaacgcgaccgccucguucaucuacaacgggcgccugguggacuccaucgucagcugguccaagaagauccugcggacccaggagagcgagugcgugugcaucaacgggaccugcacgguggucaugaccgacggguccgccucgggcaaggccgacaccaagauccucuucaucgaggagggcaagaucgugcacaccagcacgcuguccgggucggcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcucgggccuggugggcgacacgccccgcaagaacgacuccagcuccucgucccacugccucgaccccaacaacgaggagggcggccacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaagcaggagaccgaggugcuguggaccuccaacagcaucgucguguucugcggcaccuccgggaccuacggcacggggagcuggccggacggcgccgacaucaaccugaugcccaucuga

SEQ ID NO: 24369 - RNA, 1410 nt, Artificial Sequence
  derived and/or modified CDS sequence (AUadapt) from InfluenzaA__AFG72870__NA
augaaccccaaccagaagaucaucaccaucggcucggugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucucgaaggacaacuccauccgccucagcgccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgaagcaggucugcaucgccugguccagcuccucgugccacgacggcaaggcguggcugcacgugugcgugaccggggacgacgagaacgccaccgccuccuucaucuacaacggccgccugguggacagcaucggguccuggucgaagaagauccuccggacccaggaguccgagugcgucugcaucaacggcacgugcaccguggugaugaccgacggcagcaccuccgggaaggccgacacgaagauccuguucaucgaggagggcaagaucguccacaucucgacccugagcggguccgcgcagcacguggaggagugcucgugcuacccccgcuaccccggcgugcggugcgucugccgcgacaacuggaagggcuccaaccggccgaucguggacaucaacgugaaggacuacagcaucgucuccucguacgugugcuccgggcucgugggcgacacgccccgcaagaacgacagcuucuccucgucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggucgaagcccaacuccaagcuccagaucaaccgccaggugaucguggagcggggcaaccggagcggguacuccggcaucuucucggucgaguccaagagcugcaucaaccgcugcuucuacguggagcugauccggggccgcaaggaggagaccgaggugugguggaccucgaacuccaucgucguguucugcgggaccagcggcacguacgggaccggcuccuggccggacggggccgacaucaaccugaugcccaucuga

SEQ ID NO: 24370 - RNA, 1410 nt, Artificial Sequence
  derived and/or modified CDS sequence (AUadapt) from InfluenzaA__AFG72892__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggagaagaccgaggugcuguggaccuccaacagcaucgucguguucugcggcaccuccgggacguacggcaccgggagcuggccggacggcgccgacaucaaccugaugcccaucuga

SEQ ID NO: 24371 - RNA, 1410 nt, Artificial Sequence
  derived and/or modified CDS sequence (AUadapt) from InfluenzaA__AFG72903__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaaggacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcgaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 24372 - RNA, 1410 nt, Artificial Sequence
  derived and/or modified CDS sequence (AUadapt) from InfluenzaA__AFG72936__NA
augaaccccaaccagaagaucaucaccaucggcucggugucccugaccaucagcacgaucugcuucuucauccagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaucguccgcgaccggaccccguaccgcacccugcucaugaacgagcugggcgugcccuuccaccugggcaccaagcaggucugcaucgccuggagcuccucguccugccacgacgggaaggccuggcuccacgugugcaucacgggcgacgacaagaacgcgaccgccagcuucaucuacaacgggcggcugguggacuccguggucagcugguccaaggagauccugcgcacccaggagucggagugcgugugcaucaacgggaccugcacgguggucaugaccgacggguccgccagcggcaaggccgacaccaagauccucuucaucgaggagggcaagaucgugcacaccucgacgcuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccagcucccacugccucgaccccaacaacgaggagggcggccacggggucaagggcugggccuucgacgacgggaacgacguguggaugggccgcaccaucucggagaagucccggcugggcuacgagaccuucaaggucaucgagggguggagcaaccacaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggaccuacggcacggggagcuggcccgacggcgccgaccugaaccucaugccgaucuga

SEQ ID NO: 24373 - RNA, 1410 nt, Artificial Sequence
  derived and/or modified CDS sequence (AUadapt) from InfluenzaA__AFG72958__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaucguccgcgaccggaccccguaccgcacccugcucaugaacgagcugggcgugcccuuccaccugggcaccaagcaggucugcaucgccuggagcuccucguccugccacgacgggaaggccuggcuccacgugugcaucacgggcgacgacaagaacgcgaccgccagcuucaucuacaacgggcggcugguggacuccguggucucgugguccaaggagauccugcgcacccaggagagcgagugcgugugcaucaacgggaccugcacgguggucaugaccgacggguccgccucgggcaaggccgacaccaagauccucuucaucgaggagggcaagaucgugcacaccagcacgcuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccucgucccacugccucgaccccaacaacgaggagggcggccacggggucaagggcugggccuucgacgacgggaacgacguguggaugggccgcaccaucaacgagaccagccggcugggcuacgagaccuucaaggucaucgaggggugguccaaccccaagucgaagcugcagaucaaccgccaggugaucguggaccggggcaaccgcuccggguacagcggcaucuucuccgucgagggcaagucgugcaucaaccggugcuucuacguggagcucauccgcgggcggaaggaggagaccgaggugcuguggaccagcaacuccaucgucguguucugcggcaccagcgggacguacggcaccggguccuggccggacggcgccgaccugaaccucaugcccaucuga

SEQ ID NO: 24374 - RNA, 1410 nt, Artificial Sequence; identical to SEQ ID NO: 16505
  derived and/or modified CDS sequence (AUadapt) from InfluenzaA__AFG98811__NA

SEQ ID NO: 24375 - RNA, 1410 nt, Artificial Sequence
  derived and/or modified CDS sequence (AUadapt) from InfluenzaA__AFG98822__NA
augaaccccaaccagaagaucaucaccaucggcucggugucccugaucaucgccaccgucugcuuccucaugcagaucgccauccuggugacgaccgugacccugcacuucaagcagcacgagugcgacucgccguccagcaaccaggucaugcucugcgagcccaucaucaucgagcgcaacaucaccgagaucguguaccugaacaacacgaccaucgagaaggagaccugccccaagcugguggaguaccggaacugguccaagccccagugcaagaucaccggguucgcgccguucucgaaggacaacuccauccgccucagcgccggcggggacaucugggucacgcgggagcccuacguguccugcgaccccggcaagugcuaccaguucgcccuggggcagggcaccacccuggacaacaagcacucgaacgacaccauccacgaccgcaucccccaccggacgcuccugaugaacgagcugggcgugccguuccaccucgggacccgccaggucugcaucgccugguccagcuccucgugccacgacggcaaggccuggcugcacgugugcgugaccggggacgacaagaacgcgaccgccuccuucaucuacgacggccggcuggucgacucgaucggguccuggagccagaacauccuccgcacgcaggaguccgagugcgugugcaucaacgggaccugcaccguggucaugaccgacggcucggccagcggccgggccgacacgcgcauccuguucaucgaggagggcaagaucgugcacaucucgccccuguccggguccgcgcagcacguggaggagugcagcugcuacccccgguaccccgacguccgcugcaucugccgggacaacuggaagggcuccaaccgcccgaucguggacaucaacaugaaggacuacucgaucgacuccagcuacgugugcuccggccucgucggggacacgccccggaacgacgaccgcucguccaagucgaacugccggaaccccaacaacgagcgcggcaaccacggggugaagggcugggccuucgacaacgggaacgacguguggaugggccggaccaucuccaaggaccugcgcagcggcuacgagaccuucaaggucaucgggggcugguccacccccaacucgaagucccagaucaaccgccaggugaucgucgacagcgacaaccgguccggguacucgggcaucuucagcguggaggggaaguccugcaucaaccgcugcuucuacguggagcugauccggggccgcgagcaggagacccgggucugguggaccucgaacuccaucgugguguucugcggcaccagcgggacguacggcaccggguccuggccggacggcgccaacaucaacuucaugcccaucuga

SEQ ID NO: 24376 - RNA, 1410 nt, Artificial Sequence; identical to SEQ ID NO: 22529
  derived and/or modified CDS sequence (AUadapt) from InfluenzaA__AFG98833__NA

SEQ ID NO: 24377 - RNA, 1410 nt, Artificial Sequence
  derived and/or modified CDS sequence (AUadapt) from InfluenzaA__AFG98844__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaugugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccugaacaaccgccacagcaacgacacgauccacgaccggaucccgcaccgcacccugcucaugaacgagcugggcgugcccuuccaccuggggacccgccaggugugcaucgccugguccucguccucgugccacgacggcaaggcguggcuccacgucugcgugaccggggacgacaagaacgccacggccuccuucaucuacgacggccgccugguggacagcaucggguccuggucgcagaacauccugcggacccaggaguccgagugcgucugcaucaaccggaccugcaccguggugaugacggacggcagcgccuccggcaaggcggacacccggauccucuucaucgaggaggggaagaucguccacaucucgccccugucgggcuccgcccagcacguggaggagugcagcugcuacccccgcuacccgggggugcggugcaucugccgcgacaacuggaagggcuccaaccggcccgucguggacaucaacgugaaggacuacucgaucgacuccagcuacgucugcuccggccuggugggggacacgccccgcaacaacgaccggucguccucguccuacugccgcaaccccaacaacgagcggggcaaccacggggugaagggcugggccuucgacgacgagaacgacgucuggauggggcgcaccaucagcaaggacucccggucgggcuacgagaccuucaaggugaucggcgggugguccaccccgaacagcaagucccagaucaaccgccaggucaucguggacucggacaaccgcuccggcuacucggggaucuucagcguggagggcaaguccugcaucaaccggugcuucuacgucgagcucauccgcgggcgggagcaggagacccgcgugugguggaccucgaacuccaucguggucuucugcggcacgagcggcaccuacgggaccggcuccuggcccgacggggccgacaucaaccugaugcccaucuga

SEQ ID NO: 24378 - RNA, 1410 nt, Artificial Sequence; identical to SEQ ID NO: 16520
  derived and/or modified CDS sequence (AUadapt) from InfluenzaA__AFG98855__NA

SEQ ID NO: 24379 - RNA, 1410 nt, Artificial Sequence; identical to SEQ ID NO: 17374
  derived and/or modified CDS sequence (AUadapt) from InfluenzaA__AFG98866__NA

SEQ ID NO: 24380 - RNA, 1410 nt, Artificial Sequence
  derived and/or modified CDS sequence (AUadapt) from InfluenzaA__AFG98877__NA
augaaccccaaccagaagaucaucaccaucggcucggugucccugaccaucgccacgaucugcuuccucaugcagaucgccauccuggucaccaccgugacccugcacuucaagcaguacgagugcgacucgccgcccaacaaccaggugaugcccugcgagcccaucaucaucgagcgcaacaucacggagaucgucuaccucaccaacaccaccaucgagaaggagaucugcccgaagcugguggaguaccggaacugguccaagccccagugcaagaucacgggguucgcgcccuucagcaaggacaacuccauccgccugucggccggcggggacaucugggugacccgggagcccuacgucuccugcgacccgggcaagugcuaccaguucgcccucgggcagggcaccacccuggacaacaagcacucgaacgacacgauccacgaccgcacgccccaccggacccugcucaugaacgagcugggcgugcccuuccaccuggggacccgccaggugugcaucgccugguccagcuccucgugccacgacggcaaggccuggcuccacgucugcgugaccggguacgacaagaacgcgaccgccuccuucaucuacgacggccggcugguggacagcaucggguccuggucgcagaacauccugcgcacccaggaguccgagugcgucugcaucaacgggaccugcacgguggugaugaccgacggcucggccuccggccgggccgacaccaagauccucuucaucgaggagggcaagaucguccacaucagcccccugucgggguccgcgcagcacguggaggagugcucgugcuacccgcgcuaccccggcgugcggugcaucugccgcgacaacuggaagggcuccaaccggcccgucguggacaucaacgugaaggacuacagcaucgacuccucguacgucugcuccgggcuggugggcgacacgccccgcaacaacgaccggagcuccaacucguacugccgcaacccgaacaacgagaaggggaaccacggcgugaaggggugggccuucgacgacggcaacgacgucuggaugggccggaccaucuccgaggacucgcgcuccggguacgagaccuucaaggugaucggcggguggagcacccccaacuccaagcuccagaucaaccggcaggucaucguggacucggacaaccgcuccggcuacucggggaucuucuccguggagggcaagagcugcaucaaccggugcuucuacgucgagcugauccgcggccgcgagcaggagacccgggugugguggacgucgaacuccaucguggucuucugcgggaccagcggcaccuacgggaccggcuccuggcccgacggggccgacaucaaccugaugcccaucuga

SEQ ID NO: 24381 - RNA, 1410 nt, Artificial Sequence; identical to SEQ ID NO: 16520
  derived and/or modified CDS sequence (AUadapt) from InfluenzaA__AFG98888__NA

SEQ ID NO: 24382 - RNA, 1410 nt, Artificial Sequence
  derived and/or modified CDS sequence (AUadapt) from InfluenzaA__AFG98899__NA
augaaccccaaccagaagaucaucaccaucggcucggugucccugaucaucgccaccaucugcuuccucaugcagaucgccauccuggucacgaccgugacccugcacuucaagcaguacgagugcgacucgccggcgaacaaccaggugaugcccugcgagcccaucaucaucgagcgcaacaucaccgagaucgucuaccucacgaacaccaccaucgagaaggagaucugccccaagcugguggaguaccggaacugguccaagccgcagugcaagaucaccggguucgcccccuucagcaaggacaacuccauccgccugucggccggcggggacaucugggugacgcgggagcccuacgucuccugcgaccccggcaagugcuaccaguucgcccucgggcagggcaccacccuggacaacaagcacagcaacgacaccauccacgaccgcacgccgcaccggacccugcucaugaacgagcugggcgugcccuuccaccuggggacccgccaggugugcaucgccugguccucguccucgugccacgacggcaaggcguggcuccacgucugcgugaccggguacgacaagaacgccacggccuccuucaucuacgacggccggcugguggacagcaucggguccuggucgcagaacauccugcgcacccaggaguccgagugcgucugcaucaacgggaccugcaccguggugaugacggacggcagcgccuccggccgggcggacaccaagauccucuucaucgaggagggcaagaucguccacaucucgccccugagcggguccgcccagcacguggaggagugcucgugcuacccccgcuacccgggcgugcggugcaucugccgcgacaacuggaagggcuccaaccggcccgucguggacaucaacgugaaggacuacucgaucgacuccagcuacgucugcuccgggcuggugggcgacacgccccgcaacaacgaccggucguccaacagcuacugccgcaaccccaacaacgagaaggggaaccacggcgugaaggggugggccuucgacgacggcaacgacgucuggaugggccggaccaucuccgaggacucgcgcuccggguacgagaccuucaaggugaucggcggguggucgaccccgaacuccaagcuccagaucaaccggcaggucaucguggacagcgacaaccgcuccggcuacucggggaucuucuccguggagggcaagagcugcaucaaccggugcuucuacgucgagcugauccgcggccgcgagcaggagacccgggugugguggaccucgaacuccaucguggucuucugcgggacgagcggcaccuacgggaccggcuccuggcccgacggggccgacaucaaccugaugcccaucuga

SEQ ID NO: 24383 - RNA, 1410 nt, Artificial Sequence; identical to SEQ ID NO: 16520
  derived and/or modified CDS sequence (AUadapt) from InfluenzaA__AFG98910__NA

SEQ ID NO: 24384 - RNA, 1410 nt, Artificial Sequence; identical to SEQ ID NO: 16520
  derived and/or modified CDS sequence (AUadapt) from InfluenzaA__AFG98921__NA

SEQ ID NO: 24385 - RNA, 1410 nt, Artificial Sequence
  derived and/or modified CDS sequence (AUadapt) from InfluenzaA__AFG98932__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucgucgagcgcaacaucacggagaucguguaccucaccaacaccaccaucgagaaggagaucugccccaagcugguggaguaccggaagugguccaagccgcagugcaagaucacgggguucgcccccuucagcaaggacaacuccauccgccugucggccggcggggacaucugggucacccgggagcccuacguguccugcgaccccggcaagugcuaccaguucgcccucgggcagggcaccacccuggacaacaagcacucgaacgacacgauccacgaccgcaccccgcaccggacccugcucaugaacgagcugggcgugcccuuccaccuggggacccgccaggucugcaucgccugguccagcuccucgugccacgacggcaaggcguggcuccacgugugcgugacgggguacgacaagaacgccaccgccuccuucaucuacgacggccggcuggucgacagcaucggguccuggucgcagaacauccugcgcacccaggaguccgagugcgugugcaucaacgggaccugcacgguggucaugaccgacggcucggccuccggccgggcggacaccaagauccucuucaucgaggagggcaagaucgugcacaucagcccccugucgggguccgcccagcacguggaggagugcucgugcuacccccgcuacccgggcguccggugcaucugccgcgacaacuggaagggcuccaaccggcccgugguggacaucaacgucaaggacuacagcaucgacuccucguacgugugcuccgggcuggugggcgacacgccccgcaacaacgaccggagcuccaacucguacugccgcaaccccaacaacgagaaggggaaccacggcgucaaggggugggccuucgacgacggcaacgacguguggaugggccggaccaucuccgaggacucgcgcuccggguacgagaccuucaaggucaucggcggguggagcaccccgaacuccaagcuccagaucaaccgccaggugaucguggacucggacaaccgguccggcuacucggggaucuucuccgucgagggcaagagcugcaucaaccggugcuucuacguggagcugauccgcggccgcgagcaggagacccgggugugguggacgucgaacuccaucgucguguucugcgggaccagcggcaccuacgggaccggcuccuggcccgacggggccgacaucaaccugaugcccaucuga

SEQ ID NO: 24386 - RNA, 1410 nt, Artificial Sequence
  derived and/or modified CDS sequence (AUadapt) from InfluenzaA__AFG98943__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccuggacaacaagcacucgaacgacacgauccacgaccgcaccccgcaccggacccugcucaugaacgagcugggcgugcccuuccaccuggggacccgccaggugugcaucgccugguccagcuccucgugccacgacggcaaggcguggcuccacgucugcgugacgggguacgacaagaacgccaccgccuccuucaucuacgacggccggcugguggacagcaucggguccuggucgcagaacauccugcgcacccaggaguccgagugcgucugcaucaacgggaccugcacgguggugaugaccgacggcucggccuccggccgggcggacaccaagauccucuucaucgaggagggcaagaucguccacaucagcccccugucgggguccgcccagcacguggaggagugcucgugcuacccccgcuacccgggcgugcggugcaucugccgcgacaacuggaagggcuccaaccggcccgucguggacaucaacgugaaggacuacagcaucgacuccucguacgucugcuccgggcuggugggcgacacgccccgcaagaacgaccggagcuccaacucguacugccgcaaccccaacaacgagaaggggaaccacggcgugaaggggugggccuucgacgacggcaacgacgucuggaugggccggaccaucuccgaggacucgcgcuccggguacgagaccuucaaggugaucggcggguggagcaccccgaacuccaagcuccagaucaaccggcaggucaucguggacucggacaaccgcuccggcuacucggggaucuucuccguggagggcaagagcugcaucaaccggugcuucuacgucgagcugauccgcggccgcgagcaggagacccgggugugguggacgucgaacuccaucguggucuucugcgggaccagcggcaccuacgggaccggcuccuggcccgacggggccgacaucgaccugaugcccaucuga

SEQ ID NO: 24387 - RNA, 1410 nt, Artificial Sequence
  derived and/or modified CDS sequence (AUadapt) from InfluenzaA__AFG98965__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccacgaucaucgagcgcaacaucaccgagaucgucuaccucaccaacaucaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccuggacaacaagcacucgaacgacacgauccacgaccgcaccccgcaccggacccugcucaugaacgagcugggcgugcccuuccaccuggggacccgccaggugugcaucgccugguccagcuccucgugccacgacggcaaggcguggcuccacgucugcgugacgggguacgacaagaacgccaccgccuccuucaucuacgacggccggcugguggacagcaucggguccuggucgcagaacauccugcgcacccaggaguccgagugcgucugcaucaacgggaccugcacgguggugaugaccgacggcucggccuccggccgggcggacaccaagauccucuucaucgaggagggcaagaucguccacaucagcccccugucgggguccgcccagcacguggaggagugcucgugcuacccccgcuacccgggcgugcggugcaucugccgcgacaacuggaagggcuccaaccggcccgucguggacaucaacgugaaggacuacagcaucgacuccucguacgucugcuccgggcuggugggcgacacgccccgcaacaacgaccggagcuccaacucguacugccgcaaccccaacaacgagaaggggaaccacggcgugaaggggugggccuucgacgacggcaacgacgucuggaugggccggaccaucuccgaggacucgcgcuccggguacgagaccuucaaggugaucggcggguggagcaccccgaacuccaagcuccagaucaaccggcaggucaucguggacucggacaaccgcuccggcuacucggggaucuucuccguggagggcaagagcugcaucaaccggugcuucuacgucgagcugauccgcggccgcgagcaggagacccgggugugguggacgucgaacuccaucguggucuucugcgggaccagcggcaccuacggggccggcuccuggcccgacggggccgacaucaaccugaugcccaucuga

SEQ ID NO: 24388 - RNA, 1410 nt, Artificial Sequence
  derived and/or modified CDS sequence (AUadapt) from InfluenzaA__AFG98976__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucgccaacaccaccaucgagaaggagaucugccccaagcugguggaguaccggaacugguccaagccgcagugcaagaucaccggguucgcccccuucagcaaggacaacuccauccgccugucggccggcggggacaucugggugacgcgggagcccuacgucuccugcgaccccggcaagugcuaccaguucgcccucgggcagggcaccacccuggacaacaagcacagcaacgacaccauccacgaccgcacgccgcaccggacccugcucaugaacgagcugggcgugcccuuccaccuggggacccgccaggugugcaucgcgugguccucguccagcugccacgacggcaaggccuggcuccacgucugcgugaccggguacgacaagaacgccacggccuccuucaucuacgacggccggcugguggacucgaucggguccuggucgaagaacauccugcgcacccaggaguccgagugcgucugcaucaacgggaccugcaccguggugaugacggacggcagcgcguccggccgggccgacaccaagauccucuucaucgaggagggcaagaucguccacaucucgccccugagcggguccgcccagcacguggaggagugcucgugcuacccccgcuacccgggcgugcggugcaucugccgcgacaacuggaagggcuccaaccggcccgucguggacaucaacgugaaggacuacagcaucgacuccucguacgucugcuccgggcuggugggcgacacgccccgcaacaacgaccggagcuccucguccuacugccgcaaccccaacaacgagaaggggaaccacggcgugaaggggugggccuucgacgacggcaacgacgucuggaugggccggaccaucucggaggacucccgcagcggguacgagaccuucaaggugaucggcgggugguccaccccgaacucgaagcuccagaucaaccggcaggucaucguggacuccgacaaccgcagcggcuacuccgggguguucucggucgagggcaagagcugcaucaaccggugcuucuacguggagcugauccgcggccgcgagcuggagacccgggugugguggaccuccaacucgaucgucguguucugcgggacguccggcaccuacgggaccggcagcuggcccgacggggccgacaucaaccucaugcccaucuga

SEQ ID NO: 24389 - RNA, 1410 nt, Artificial Sequence; identical to SEQ ID NO: 24388
  derived and/or modified CDS sequence (AUadapt) from InfluenzaA__AFG98987__NA

SEQ ID NO: 24390 - RNA, 1410 nt, Artificial Sequence
  derived and/or modified CDS sequence (AUadapt) from InfluenzaA__AFG98998__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccuggagaacaagcacagcaacgacacgauccacgaccgcaccccgcaccggacccugcucaugaacgagcugggcgugcccuuccaccuggggacccgccaggugugcaucgccugguccucguccucgugccacgacggcaaggcguggcuccacgucugcgugacgggguacgacaagaacgccaccgccuccuucaucuacgacggccggcugguggacagcaucggguccuggucgcagaacauccugcgcacccaggaguccgagugcgucugcaucaacgggaccugcacgguggugaugaccgacggcagcgccuccggccgggcggacaccaagauccucuucaucgaggagggcaagaucguccacaucucgccccugucgggguccgcccagcacguggaggagugcagcugcuacccccgcuacccgggcgugcggugcaucugccgcgacaacuggaagggcuccaaccggcccgucguggacaucaacgugaaggacuacucgaucgacuccagcuacgucugcuccgggcuggugggcgacacgccccgcaagaacgaccggucguccucguccuacugccgcaaccccaacaacgagaaggggaaccacggcgugaaggggugggccuucgacgacggcaacgacgucuggaugggccggaccaucagcgaggacucccgcucgggguacgagaccuucaaggugaucggcgggugguccaccccgaacagcaagcuccagaucaaccggcaggucaucguggacuccgccaaccgcucgggcuacuccgggaucuucucgguggagggcaagagcugcaucaaccggugcuucuacgucgagcugauccgcggccgcgagcaggagacccgggugugguggacguccaacucgaucguggucuucugcgggaccuccggcaccuacgggaccggcagcuggcccgacggggccgacaucaaccugaugcccaucuga

SEQ ID NO: 24391 - RNA, 1410 nt, Artificial Sequence; identical to SEQ ID NO: 24388
  derived and/or modified CDS sequence (AUadapt) from InfluenzaA__AFG99009__NA

SEQ ID NO: 24392 - RNA, 1410 nt, Artificial Sequence
  derived and/or modified CDS sequence (AUadapt) from InfluenzaA__AFG99020__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccuggacaacaagcacucgaacgacacgauccacgaccgcaccccgcaccggacccugcucaugaacgagcugggcgugcccuuccaccuggggacccgccaggugugcaucgccugguccagcuccucgugccacgacggcaaggcguggcuccacgucugcgugacgggguacgacaagaacgccaccgccuccuucaucuacgacggccggcugguggacucgaucggguccuggagccagaacauccugcgcacccaggaguccgagugcgucugcaucaacgggaccugcacgguggugaugaccgacggcucggccuccggccgggcggacaccaagauccucuucaucgaggagggcaagaucguccacaccucgccccugagcggguccgcccagcacguggaggagugcucgugcuacccccgcuacccgggcgugcggugcaucugccgcgacaacuggaagggcuccaaccggcccgucguggacaucaacgugaaggacuacagcaucgacuccucguacgucugcuccgggcuggugggcgacacgccccgcaacaacgaccggucguccagcuccuacugccgcaaccccaacaacgagaaggggacccacggcgugaaggggugggccuucgacgacggcaacgacgucuggaugggccggaccaucucggaggacucccgcucgggguacgagaccuucaaggugaucggcgggugguccacgccgaacagcaagcuccagaucaaccggcaggucaucguggacuccgacaaccgcucgggcuacuccgggaucuucucgguggagggcaagagcugcaucaaccggugcuucuacgucgagcugauccgcggccgcgagcaggagacccgggugugguggaccuccaacucgaucguggucuucugcgggaccuccggcacguacgggaccggcagcuggcccgacggggccgacaucaacaucaugcccaucuga

SEQ ID NO: 24393 - RNA, 1410 nt, Artificial Sequence
  derived and/or modified CDS sequence (AUadapt) from InfluenzaA__AFG99031__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccuggacaacaagcacucgaacgacacgauccacgaccgcaccccgcaccggacccugcucaugaacgagcugggcgugcccuuccaccuggggacccgccaggugugcaucgccugguccagcuccucgugccacgacggcaaggcguggcuccacgucugcgugacgggguacgacaagaacgccaccgccuccuucaucuacgacggccggcugguggacucgaucggguccuggagccagaacauccugcgcacccaggaguccgagugcgucugcaucaacgggaccugcacgguggugaugaccgacggcucggccuccggccgggcggacaccaagauccucuucaucgaggagggcaagaucguccacaccucgccccugagcggguccgcccagcacguggaggagugcucgugcuacccccgcuacccgggcgugcggugcaucugccgcgacaacuggcggggcuccaaccgccccgucguggacaucaacgugaaggacuacagcaucgacuccucguacgucugcuccgggcuggugggcgacacgccccggaacaacgaccgcucguccagcuccuacugccggaaccccaacaacgagaaggggacccacggcgugaaggggugggccuucgacgacggcaacgacgucuggaugggccgcaccaucucggaggacucccggucgggguacgagaccuucaaggugaucggcgggugguccacgccgaacagcaagcuccagaucaaccgccaggucaucguggacuccgacaaccggucgggcuacuccgggaucuucucgguggagggcaagagcugcaucaaccgcugcuucuacgucgagcuggugcgcggccgggagcaggagacccgcgugugguggaccuccaacucgaucgucguguucugcgggaccuccggcacguacgggaccggcagcuggcccgacggggccgacaucaaccugaugcccaucuga

SEQ ID NO: 24394 - RNA, 1410 nt, Artificial Sequence; identical to SEQ ID NO: 16978
  derived and/or modified CDS sequence (AUadapt) from InfluenzaA__AFG99042__NA

SEQ ID NO: 24395 - RNA, 1410 nt, Artificial Sequence
  derived and/or modified CDS sequence (AUadapt) from InfluenzaA__AFG99053__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccucguccagcugccacgacggcaaggcguggcuccacgucugcgugacgggguacgacaagaacgccaccgccuccuucaucuacgacggccggcugguggacucgaucggguccuggucgcagaacauccugcgcacccaggaguccgagugcgucugcaucaacgggaccugcacgguggugaugaccgacggcagcgccuccggccgggcggacaccaagauccucuucaucgaggagggcaagaucguccacaccucgagccuguccgggucggcccagcacguggaggagugcuccugcuacccccgcuaccccggcgugcggugcaucugccgcgacaacuggaagggcagcaaccggccggucguggacaucaacgugaaggacuacuccaucgacucguccuacgucugcagcgggcuggugggcgacacgccccgcaacaacgaccgguccucguccucguacugccgcaaccccaacaacgagaaggggacccacggcgugaaggggugggccuucgacgacggcaacgacgucuggaugggccggaccaucuccgaggacagccgcuccggguacgagaccuucaaggugaucggcggguggucgauccccaacuccaagcuccagaucaaccggcaggucaucguggacagcgacaaccgcuccggcuacucggggaucuucagcguggagggcaaguccugcaucaaccggugcuucuacgucgagcugauccgcggccgcgagcaggagacgcgggugugguggaccucgaacuccaucguggucuucugcgggaccagcggcaccuacgggacgggcuccuggccggacggggccgacaucaaccugaugcccaucuga

SEQ ID NO: 24396 - RNA, 1410 nt, Artificial Sequence
  derived and/or modified CDS sequence (AUadapt) from InfluenzaA__AFG99064__NA
augaaccccaaccagaagaucaucaccaucggcucggugucccugaccaucgccacggucugcuuccucaugcagaucgccauccuggugaccaccgugacccugcacuucaagcaguacgagugcgacucgccgcccaacaaccaggucaugcccugcgagcccaucaucaucgagcgcaacgugacggagaucguguaccucaccaacaccaccaucgagaaggagaucugcccgaagcuggucgaguaccggaacugguccaagccccagugcaagaucacgggguucgcgcccuucagcaaggacaacuccauccgccugucggccggcggggacaucugggugacccgggagcccuacguguccugcgacccgagcaagugcuaccaguucgcccucggccaggggaccacccuggacaacaagcacuccaacgacacgauccacgaccgcacgccccaccggacccugcucaugaacgagcugggcguccccuuccaccugggcacccgccaggugugcaucgccuggucguccagcuccugccacgacgggaaggccuggcuccacgugugcaucaccggcuacgacaagaacgcgaccgccucguucaucuacgacgggcggcuggucgacuccaucggcagcugguccaagaacauccugcgcacccaggagucggagugcgugugcaucaacgggaccugcacgguggucaugaccgacggcuccgccagcgagcgggccgacaccaagauccucuucaucgaggagggcaagaucgugcacaucucgccccuguccgggagcgcgcagcacguggaggagugcuccugcuacccgcgcuaccccggcguccggugcaucugccgcgacaacuggaaggggucgaaccggcccgugguggacaucaacgucaaggacuacuccaucgugagcuccuacgugugcucgggccuggucggcgacacgccccgcaagaacgaccgguccagcuccucguacugccgcaacccgaacaacgagaaggggaaccacggcgugaaggggugggccuucgacgacggcaacgacgucuggauggggcggaccaucuccgaggagagccgcuccggcuacgagaccuucaaggugaucggcggguggucgacccccaacuccaagcuccagaucaaccgccaggugaucgucgacagcgacaaccgguccggcuacucggggaucuucagcguggagggcaaguccugcaucaaccggugcuucuacguggagcugauccgcgggcgcgagcaggagacccgggucugguggacgucgaacuccaucgugguguucugcggcaccagcggcaccuacgggaccggcuccuggcccgacggggccgacaucaaccugaugcccaucuga

SEQ ID NO: 24397 - RNA, 1410 nt, Artificial Sequence
  derived and/or modified CDS sequence (AUadapt) from InfluenzaA__AFG99086__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacgucacggagaucguguaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggucacccgggagcccuacguguccugcgaccccggcaagugcuaccaguucgcccucgggcagggcaccacccuggacaacaagcacagcaacgacacgauccacgaccgcaccccguaccggacccugcucaugaacgagcugggcgugcccuuccaccuggggacccgccaggucugcaucgccugguccucguccagcugccacgacggcaaggcguggcuccacgugugcgugacgggguacgacaagaacgccaccgccuccuucaucuacgacggccggcuggucgacucgaucggguccuggagcaagaacauccugcgcacccaggaguccgagugcgugugcaucaacgggaccugcacgguggucaugaccgacggcucggccuccgagcgggcggacaccaagauccucuucaucgaggaggggaagaucgugcacaucagcccccugucgggcuccgcccagcacguggaggagugcagcugcuacccccgcuacccggggguccggugcaucugccgcgacaacuggaagggcuccaaccggcccgugguggacaucaacgucaaggacuacucgaucguguccagcuacgugugcuccggccuggucggggacacgccccgcaagaacgaccggucguccagcuccuacugccgcaaccccaacaacgagaagggcaaccacggggugaagggcugggccuucgacgacgggaacgacgucuggaugggccggaccaucucggaggagucccgcagcggcuacgagaccuucaaggugaucgggggcugguccaccccgaacucgaagcuccagaucaaccgccaggugaucgucgacuccgacaaccggagcggguacuccggcaucuucucgguggagggcaagagcugcaucaaccggugcuucuacguggagcugauccgcggccgcgagcaggagacccgggucugguggacguccaacucgaucgugguguucugcggcaccuccgggaccuacggcaccgggagcuggcccgacggcgccgacaucaaccugaugcccaucuga

SEQ ID NO: 24398 - RNA, 1410 nt, Artificial Sequence
  derived and/or modified CDS sequence (AUadapt) from InfluenzaA__AFG99097__NA
augaaccccaaccagaagaucaucaccaucggcucggugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacgucacggagaucguguaccucaccaacaccaccaucgagaaggagaucugccccaagcugguggaguaccggaacugguccaagccgcagugcaagaucacgggguucgcccccuucucgaaggacaacuccauccgccugagcgccggcggggacaucugggucacccgggagcccuacguguccugcgaccccggcaagugcuaccaguucgcccucgggcagggcaccacccuggacaacaagcacucgaacgacacgauccacgaccgcaccccguaccggacccugcucaugaacgagcugggcgugcccuuccaccuggggacccgccaggucugcaucgccugguccagcuccucgugccacgacggcaaggcguggcuccacgugugcgugacgggguacgacaagaacgccaccgccuccuucaucuacgacggccggcuggucgacagcaucggguccuggucgaagaacauccugcgcacccaggaguccgagugcgugugcaucaacgggaccugcacgguggucaugaccgacggcagcgccuccgagcgggcggacaccaagauccucuucaucgaggaggggaagaucgugcacaucucgccccugagcggcuccgcccagcacguggaggagugcucgugcuacccccgcuacccggggguccggugcaucugccgcgacaacuggaagggcuccaaccggcccgugguggacaucaacgucaaggacuacagcaucguguccucguacgugugcuccggccuggucggggacacgccccgcaagaacgaccggagcuccucguccuacugccgcaaccccaacaacgagaagggcaaccacggggugaagggcugggccuucgacgacgggaacgacgucuggaugggccggaccaucagcgaggagucccgccucggcuacgagaccuucaaggugaucgggggcuggucgaccccgaacuccaagcugcagaucaaccgccaggugaucgucgacagcgacaaccgguccggguacucgggcaucuucuccguggagggcaagagcugcaucaaccggugcuucuacguggagcugauccgcggccgcgagcaggagacccgggucugguggacgucgaacuccaucgugguguucugcggcaccagcgggaccuacggcaccggguccuggcccgacggcgccgacaucaaccucaugcccaucuga

SEQ ID NO: 24399 - RNA, 1410 nt, Artificial Sequence
  derived and/or modified CDS sequence (AUadapt) from InfluenzaA__AFG99119__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacucgauccgccuguccgccggcggggacaucugggugacccgggagcccuacgucagcugcgacccgggcaagugcuaccaguucgcccucgggcagggcaccacccuggacaacaagcacuccaacgacacgauccacgaccgcacccccuaccggacccugcucaugaacgagcugggcgugcccuuccaccuggggacccgccaggugugcaucgccuggucguccagcuccugccacgacggcaaggccuggcuccacgucugcgugacggggcacgacaagaacgcgaccgccucguucaucuacgacggccggcugguggacuccaucgggagcugguccaagaacauccugcgcacccaggagucggagugcgucugcaucaacgggaccugcacgguggugaugaccgacggcuccgccagcgagcgggccgacaccaagauccucuucaucgaggagggcaagaucguccacaucucgccccuguccggcagcgcgcagcacguggaggagugcuccugcuacccgcgcuaccccggggugcggugcgucugccgcgacaacuggaagggcucgaaccggcccaucguggacaucaacgugaaggacuacuccaucgucagcuccuacgugugcucgggccuggugggggacacgccccgcaagaacgaccgguccagcuccucguacugccgcaacccgaacaacgagaagggcaaccacggggucaagggcugggccuucgacgacgggaacgacguguggaugggccggaccaucuccgaggagagccgcuccggcuacgagaccuucaaggucaucgggggcuggucgacccccaacuccaagcuccagaucaaccgccaggugaucguggacagcgacaaccgguccggguacucgggcaucuucagcgucgaggggaaguccugcaucaaccggugcuucuacguggagcugauccgcggccgcgagcaggagacccgggugugguggacgucgaacuccaucgucguguucugcggcaccagcgggaccuacggcaccggguccuggcccgacggcgccgacaucaaccugaugcccaucuga

SEQ ID NO: 24400 - RNA, 1410 nt, Artificial Sequence
  derived and/or modified CDS sequence (AUadapt) from InfluenzaA__AFG99130__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgggcccaucaucaucgagcgcaacaucacggagaucgucuaccucaccaacaccaccaucgagaaggagaucugcccgaagcugguggaguaccggaacuggagcaagccccagugcaagaucacgggcuucgcgcccuucuccaaggacaacucgauccgccuguccgccgggggcgacaucugggugacccgggagcccuacgucagcugcgacccggggaagugcuaccaguucgcccucggccagggcaccacccuggacaacaagcacuccaacgacacgauccacgaccgcacccccuaccggacccugcucaugaacgagcugggggugcccuuccaccugggcacccgccaggugugcaucgccuggucguccagcuccugccacgacgggaaggccuggcuccacgucugcgugacgggccacgacaagaacgcgaccgccucguucaucuacgacgggcggcugguggacuccaucggcucgugguccaagaacauccugcgcacccaggagagcgagugcgucugcaucaacgggaccugcacgguggugaugaccgacggcuccgccucggagcgggccgacaccaagauccucuucaucgaggagggcaagaucguccacaucagcccccuguccgggucggcgcagcacguggaggagugcuccugcuacccgcgcuaccccggcgugcggugcgucugccgcgacaacuggaagggcagcaaccggcccgugguggacaucaacgucaaggacuacuccaucgugucguccuacgugugcagcgggcuggucggcgacacgccccgcaagaacgaccgguccucguccucguacugccgcaacccgaacaacgagaaggggaaccacggcgugaaggggugggccuucgacgacggcaacgacgucuggaugggccggaccaucuccgaggagagccgcuccggguacgagaccuucaaggugaucggcggguggucgacccccaacuccaagcuccagaccaaccgccaggugaucgucgacagcgacaaccgguccggcuacucggggaucuucagcguggagggcaaguccugcaucaaccggugcuucuacguggagcugauccgcggccgcgagcaggagacgcgggucugguggaccucgaacuccaucgugguguucugcgggaccagcggcaccuacgggacgggcuccuggcccgacggggccgacaucaaccugaugcccaucuga

SEQ ID NO: 24401 - RNA, 1410 nt, Artificial Sequence
  derived and/or modified CDS sequence (AUadapt) from InfluenzaA__AFG99141__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacucgauccgccuguccgccggcggggacaucugggugacccgggagcccuacgucagcugcgacccgggcaagugcuaccaguucgcccucgggcagggcaccacccuggacaacaagcacuccaacgacacgauccacgaccgcacccccuaccggacccugcucaugaacgagcugggcgugcccuuccaccuggggacccgccaggugugcaucgccuggucguccagcuccugccacgacggcaaggccuggcuccacgucugcgugacggggcacgacaagaacgcgaccgccucguucaucuacgacggccggcugguggacuccaucgggagcugguccaagaacauccugcgcacccaggagucggagugcgucugcaucaacgggaccugcacgguggugaugaccgacggcuccgccagcgagcgggccgagaccaagauccucuucaucgaggagggcaagaucguccacaucucgccccuguccggcagcgcgcagcacguggaggagugcuccugcuacccgcgcuaccccggggugcggugcgucugccgcgacaacuggaagggcucgaaccggcccgugguggacaucaacgucaaggacuacuccaucgugagcuccuacgugugcucgggccuggucggggacacgccccgcaagaacgaccgguccagcuccucguacugccgcaacccgaacaacgagaagggcaaccacggggugaagggcugggccuucgacgacgggaacgacgucuggaugggccggaccaucuccgaggagagccgcuccggcuacgagaccuucaaggugaucgggggcuggucgacccccaacuccaagcuccagaucaaccgccaggugaucgucgacagcgacaaccgguccggguacucgggcaucuucagcguggaggggaaguccugcaucaaccggugcuucuacguggagcugauccgcggccgcgagcaggagacccgggucugguggacgucgaacuccaucgugguguucugcggcaccagcgggaccuacggcaccggguccuggcccgacggcgccgacaucaaccugaugcccaucuga

SEQ ID NO: 24402 - RNA, 1410 nt, Artificial Sequence
  derived and/or modified CDS sequence (AUadapt) from InfluenzaA__AFG99152__NA
augaaccccaaccagaagaucaugaccaucggcucggugucccugaccaucgccacgaucugcuuccucaugcagaucgccauccuggucaccaccgugacccugcacuucaagcacuacgaguucagcuccccgcccaacaaccaggugaugcccugcgagcccaucaucaucgagcgcaacaucacggagaucgucuaccucaccaacaccaccaucgagaaggaggugugcccgaagcugguggaguaccggaacuggucgaagccccagugcaagaucacgggguucgcgcccuucuccaaggacaacagcauccgccuguccgccggcggggacaucugggucacccgggagcccuacgugucgugcgacccgggcaagugcuaccaguucgcccucgggcagggcaccacccugaacaacaagcacuccaacgacacgauccacgaccgcacccccuaccggacccugcucaugaacgagcugggcgugcccuuccaccuggggacccgccaggucugcaucgccuggagcuccucguccugccacgacggcaaggccuggcuccacgugugcgugacggggcacgacaagaacgcgaccgccagcuucaucuacgacggccggcuggucgacuccaucgggucgugguccaagaacauccugcgcacccaggagagcgagugcgugugcaucaacgggaccugcacgguggucaugaccgacggcuccgccucgggccgggccgacaccaagauccucuucaucgaggagggcaagaucgugcacaucagcccccuguccgggucggcgcagcacguggaggagugcuccugcuacccgcgcuaccccggcguccggugcgugugccgcgacaacuggaagggcagcaaccggcccaucguggacaucaacgucaaggacuacuccaucgugucguccuacgugugcagcgggcuggucggcgacacgccccgcaagaacgaccgguccucguccagcuacugccgcaacccgaacaacgagaaggggaaccacggcgugaaggggugggccuucgacgacggcaacgacgucuggaugggccggaccaucggggaggagcuccgcuccggcuacgagaccuucaaggugaucgggggcuggucgacccccaacuccaagcugcagaucaaccgccaggugaucgucgacagcgacaaccgguccggguacucgggcaucuucuccguggagggcaagagcugcaucaaccggugcuucuacguggagcugauccgcgggcgcgagcaggagacccggguccucuggacgucgaacuccaucgugguguucugcggcaccagcgggaccuacggcaccggguccuggcccgacggcgccgacaucaaccugaugcccaucuga

SEQ ID NO: 24403 - RNA, 1410 nt, Artificial Sequence; identical to SEQ ID NO: 21397
  derived and/or modified CDS sequence (AUadapt) from InfluenzaA__AFG99163__NA

SEQ ID NO: 24404 - RNA, 1410 nt, Artificial Sequence
  derived and/or modified CDS sequence (AUadapt) from InfluenzaA__AFG99174__NA
augaaccccucgcagaagaucaucaccaucggcuccgugagccugaccaucgccacgaucugcuuccucaugcagaucgccauccuggucaccaccgugacccugcacuucaagcaguacgagugcuccucgccgcccaacaaccaggugaugcccugcgagcccaucaucaucgagcgcaacaucacggagaucgucuaccucaccaacaccaccaucgagaaggagaucugcccgaagcugauggaguaccggaacugguccaagccccagugcaagaucacgggguucgcgcccuucagcaaggacaacuccauccgccugucggccggcggggacaucugggugacccgggagcccuacguguccugcgacccgggcaagugcuaccaguucgcccucgggcagggcaccacccuggacaacaagcacagcaacgacacgauccacgaccgcacccccuaccggacccugcucaugaacgagcugggcguccccuuccaccuggggacccgccaggugugcaucgccugguccucguccagcugccacgacggcaaggccuggcuccacgugugcgucacggggcacgacaagaacgcgaccgccuccuucaucuacgacggccggcugguggacucgaucggguccuggagcaagaacauccugcgcacccaggaguccgagugcgugugcaucaacgggaccugcacggucgugaugaccgacggcucggccagcgagcgggccgagaccaagauccucuucaucgaggaggggaagaucgugcacaucucgccccuguccggcuccgcgcagcacgucgaggagugcagcugcuacccgcgcuaccccggggugcggugcgugugccgcgacaacuggaagggcuccaaccggcccgucguggacaucaacgugaaggacuacucgaucgucuccagcuacgugugcuccggccuggugggggacacgccccgcaagaacgaccggucguccagcuccuacugccgcaacccgaacaacgagaagggcaaccacggggucaagggcugggccuucgacgacgggaacgacguguggaugggccggaccaucucggaggagucccgcagcggcuacgagaccuucaaggucaucgggggcugguccacccccaacucgaagcuccagaucaaccgccaggugaucguggacuccgacaaccggagcggguacucgggcaucuucuccgucgagggcaagagcugcaucaaccggugcuucuacguggagcugauccgcggccgcgagcaggagacccgggugugguggacguccaacucgaucgucguguucugcggcaccuccgggaccuacggcaccgggagcuggcccgacggcgccgacaucaaccugaugcccaucuga

SEQ ID NO: 24405 - RNA, 1410 nt, Artificial Sequence
  derived and/or modified CDS sequence (AUadapt) from InfluenzaA__AFG99185__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacucgauccgccuguccgccggcggggacaucugggugacccgggagcccuacgucagcugcgacccgggcaagugcuaccaguucgcccucgggcagggcaccacccugaacaacaagcacuccaacgacacgauccacgaccgcacccccuaccggacccugcucaugaacgagcugggcgugcccuuccaccuggggaccaagcaggucugcaucgccuggucguccagcuccugccacgacggcaaggccuggcuccacgugugcgugacggggcacgacaagaacgcgaccgccucguucaucuacgacggccgccugguggacuccaucgggagcugguccaagaacauccugcggacccaggagucggagugcgucugcaucaacgggaccugcacgguggugaugaccgacggcuccgccagcgagcgcgccgacaccaagauccucuucaucgaggagggcaagaucguccacaucucgccccuguccggcucggcgcagcacguggaggagugcuccugcuacccgcgguaccccggggugcgcugcgucugccgggacaacuggaagggcagcaaccgccccaucguggacaucaacgugaaggacuacuccaucgucucguccuacgugugcagcggccuggugggggacacgccccggaagaacgaccgcuccucguccagcuacugccggaacccgaacaacgagaagggcaaccacggggucaagggcugggccuucgacgacgggaacgacguguggaugggccgcaccaucggcgaggagcuccgguccggguacgagaccuucaaggucaucggcggguggucgacccccaacuccaagcugcagaucaaccgccaggugaucguggacagcaagaaccgguccggcuacucggggaucuucuccgucgagggcaagagcugcaucaaccgcugcuucuacguggagcugauccggggccgcgagcaggagacccgcgugugguggacgucgaacuccaucgucguguucugcgggaccagcggcaccuacgggaccggcuccuggcccgacggggccgacaucaaccucaugcccaucuga

SEQ ID NO: 24406 - RNA, 1410 nt, Artificial Sequence
  derived and/or modified CDS sequence (AUadapt) from InfluenzaA__AFG99196__NA
augaaccccaaccagaagaucaucaccaucggcucggugucccugaccaucgccacgaucugcuuccucacccagaucgccauccuggucaccaccgugacgcugcacuucaagcaguacgagugcucguccagcccgaacaaccaggugaugcccugcgagcccaucaucaucgagcgcaacaucaccgagaucgucuaccucaccaacaccacgaucgagaaggagaucugccccaagcugguggaguaccggaacugguccaagccgcagugcaagaucaccggguucgcgcccuucucgaaggacaacuccauccgccugagcgccggcggggacaucugggugacccgggagcccuacgucuccugcgaccccggcaagugcuaccaguucgcccucgggcagggcaccacgcugaacaacaagcacucgaacgacaccauccacgaccgcaccccguaccggacccugcucaugaacgagcugggcgugcccuuccaccuggggacgaagcaggucugcaucgccugguccagcuccucgugccacgacggcaaggccuggcuccacgugugcaucaccgggcacgacaagaacgcgaccgccuccuucaucuacgacggccgccugguggacucgaucggguccuggagcaagaacauccugcggacccaggaguccgagugcgugugcaucaacggcacgugcaccgucgugaugaccgacggcucggccagcgagcgcgccgacaccaagauccucuucaucgaggaggggaagaucgugcacaucucgccccuguccggcuccgcgcagcacgucgaggagugcagcugcuacccccgguacccgggggugcgcugcgugugccgggacaacuggaagggcuccaaccgccccaucgucgacaucaacgugaaggacuacucgaucguguccagcuacgucugcuccggccuggugggggacacgccccggaagaacgaccgcucguccucguccuacugccggaaccccaacaacgagaagggcaaccacggggugaagggcugggccuucgacgacgggaacgacgucuggaugggccgcaccaucggcgaggagcuccggagcggguacgagaccuucaaggugaucggcgggugguccaccccgaacucgaagcugcagaucaaccgccaggucaucguggacuccggcaaccggagcggguacuccggcaucuucucgguggagggcaagagcugcaucaaccgcugcuucuacgucgagcugauccgggggcgcgagcaggagacgcgcgugugguggaccuccaacucgaucguggucuucugcggcaccuccgggaccuacggcacggggagcuggcccgacggcgccgacaucaaccucaugcccaucuga

SEQ ID NO: 24407 - RNA, 1410 nt, Artificial Sequence
  derived and/or modified CDS sequence (AUadapt) from InfluenzaA__AFG99207__NA
augaaccccaaccagaagaucaucaccaucggcucggugucccugaccaucgccacgaucugcuuccucaugcagaucgccauccuggucaccaccgugacccugcacuucaagccguacgagugcucguccccgcccaacaaccaggugaugcccugcgagcccaucaucaucgagcgcaacaucacggagaucgucuaccucaccaacaccaccaucgagaaggagaucugccccaagcugguggaguaccggaacuggagcaagccccagugcaagaucacgggguucgcgcccuucuccaaggacaacucgauccgccuguccgccggcggggacaucugggugacccgggagccguacgucagcugcgaccccggcaagugcuaccaguucgcccucgggcagggcaccacccugaacaacaagcacuccaacgacacgauccacgaccgcacccccuaccggacccugcucaugaacgagcugggcgugcccuuccaccuggggaccaagcaggucugcaucgccuggucguccagcuccugccacgacggcaaggccuggcuccacgugugcgugacggggcacgacaagaacgcgaccgccucguucaucuacgacggccgccugguggacuccaucgggagcugguccaagaacauccugcggacccaggagucggagugcgucugcaucaacgggaccugcacgguggugaugaccgacggcuccgccagcgagcgcgccgacaccaagauccucuucaucgaggagggcaagaucguccacaucucgccgcuguccggcagcgcgcagcacguggaggagugcuccugcuacccccgguaccccggggugcgcugcgucugccgggacaacuggaagggcucgaaccgccccaucguggacaucaacgugaaggacuacuccaucgucagcuccuacgugugcucgggccuggugggggacaccccgcggaagaacgaccgcuccagcuccucguacugccggaaccccaacaacgagaagggcaaccacggggucaagggcugggccuucgacgacgggaacgacguguggaugggccgcacgaucggcgaggagcuccgguccggguacgagaccuucaaggucaucggcggguggagcacccccaacuccaagcugcagaucaaccgccaggugaucguggacucgaagucccggagcggcuacuccgggaucuucucggucgagggcaagagcugcaucaaccgcugcuucuacguggagcugauccggggccgcgagcaggagacccgcgugugguggacguccaacucgaucgucguguucugcgggaccuccggcaccuacgggaccggcagcuggcccgacggggccgacaucaaccucaugccgaucuga

SEQ ID NO: 24408 - RNA, 1410 nt, Artificial Sequence; identical to SEQ ID NO: 17216
  derived and/or modified CDS sequence (AUadapt) from InfluenzaA__AFG99218__NA

SEQ ID NO: 24409 - RNA, 1410 nt, Artificial Sequence
  derived and/or modified CDS sequence (AUadapt) from InfluenzaA__AFG99229__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccaucaucaucgagcgcaacaucacgaagaucgucuaccucaccaacaccaccaucgagaaggagaucugcccgaagcugguggaguaccggaacuggagcaagccccagugcaagaucacgggguucgcgcccuucuccaaggacaacucgauccgccuguccgccggcggggacaucugggugacccgggagcccuacgucagcugcgacccgggcaagugcuaccaguucgcccucgggcagggcaccacccugaacaacaagcacuccaacgacacgauccacgaccgcacccccuaccggacccugcucaugaacgagcugggcgugcccuuccaccuggggaccaagcaggucugcaucgccuggucguccagcuccugccacgacggcaaggccuggcuccacgugugcgugacggggcacgacaagaacgcgaccgccucguucaucuacgacggccgccugguggacuccaucgggagcugguccaagaacauccugcggacccaggagucggagugcgucugcaucaacgggaccugcacgguggugaugaccgacggcuccgccagcgagcgcgccgacaccaagauccucuucaucgaggagggcaagaucguccacaucucgccccuguccggcucggcgcagcacguggaggagugcuccugcuacccgcgguaccccggggugcgcugcgucugccgggacaacuggaagggcagcaaccgccccaucguggacaucaacgugaaggacuacuccaucgucucguccuacgugugcagcggccuggugggggacacgccccggaagaacgaccgcuccucguccagcuacugccggaacccgaacaacgagaagggcaaccacggggucaagggcugggccuucgacgacgggaacgacguguggaugggccgcaccaucggcgaggagcuccgguccggguacgagaccuucaaggucaucggcggguggucgacccccaacuccaagcugcagaucaaccgccaggugaucguggacagcaagaaccgguccggcuacucggggaucuucuccgucgagggcaagagcugcaucaaccgcugcuucuacguggagcugauccggggccgcgagcaggagacccgcgugugguggacgucgaacuccaucgucguguucugcgggaccagcggcaccuacgggaccggcuccuggcccgacggggccgacaucaaccucaugcccaucuga

SEQ ID NO: 24410 - RNA, 1410 nt, Artificial Sequence
  derived and/or modified CDS sequence (AUadapt) from InfluenzaA__AFG99240__NA
augaaccccaaccagaagaucaucaccaucggcucggugucccugaccaucgccacgaucugcuuccucaugcagaucgccauccuggucaccaccgugacccugcacuucaagcaguacgagugcagcuccccgcccucgaaccaggugaugcccugcgagcccaucaucaucgagcgcaacaucacggagaucgucuaccucaccaacaccaccaucgagaaggagaucugcccgaagcccguggaguaccggaacugguccaagccccagugcaagaucacgggguucgcgcccuucagcaaggacaacuccauccgccugucggccggcggggacaucugggugacccgggagccguacgucuccugcgaccccggcaagugcuaccaguucgcccuggggcagggcaccacccucaacaacaagcacagcaacgacacgauccacgaccgcacccccuaccggacccugcugaugaacgagcucggcgugcccuuccaccuggggaccaagcaggucugcaucgccugguccucguccagcugccacgacggcaaggccuggcugcacgugugcgugacggggcacgacaagaacgcgaccgccuccuucaucuacgacggccgccucguggacucgaucggguccuggagcaagaacauccugcggacccaggaguccgagugcgucugcaucaacgggaccugcacgguggugaugaccgacggcucggccagcgagcgcgccgacaccaagauccuguucaucgaggagggcaagaucguccacaucuccccgcucucgggcuccgcgcagcacguggaggagugcagcugcuacccccgguaccccggggugcgcugcgucugccgggacaacuggaagggcuccaaccgccccaucguggacaucaacgugaaggacuacucgaucgucuccagcuacgugugcuccggccuggugggggacaccccgcggaagaacgaccgcuucucguccagcuacugccggaaccccaacaacgagaagggcaaccacggggucaagggcugggccuucgacgacgggaacgacguguggaugggccgcacgaucggcgaggagcugcgguccggguacgagaccuucaaggucaucggcggguggucgacccccaacuccaagcuccagaucaaccgccaggugaucguggacagcaagaaccgguccggcuacucggggaucuucuccgucgagggcaagagcugcaucaaccgcugcuucuacguggagcugauccggggccgcgagcaggagacccgcgugugguggacgucgaacuccaucgucguguucugcgggaccagcggcaccuacgggaccggcuccuggcccgacggggccgacaucaaccugaugccgaucuga

SEQ ID NO: 24411 - RNA, 1410 nt, Artificial Sequence; identical to SEQ ID NO: 17215
  derived and/or modified CDS sequence (AUadapt) from InfluenzaA__AFG99251__NA

SEQ ID NO: 24412 - RNA, 1410 nt, Artificial Sequence
  derived and/or modified CDS sequence (AUadapt) from InfluenzaA__AFG99273__NA
augaaccccaaccagaagaucaucaccaucggcucggugucccugaccaucgccacgaugugcuuccucaugcagaucgccauccuggucaccaccgugacccugcacuucaagcaguacgagugcucguccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacucgauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggucguccagcuccugccacgacggcaaggccuggcuccacgugugcgugaccgggcacgacaagaacgcgaccgccucguucaucuacgacggccggcuggucgacuccaucgggucgugguccaagaacauccugcgcacccaggagagcgagugcgugugcaucaacggcacgugcaccguggucaugaccgacggcuccgccucggagcgggccgacaccaagauccucuucaucgaggaggggaagaucgugcacaucagcccccuguccggcucggcgcagcacguggaggagugcuccugcuacccgcgcuaccccgggguccggugcgugugccgcgacaacuggaagggcagcaaccggcccaucguggacaucaacgucaaggacuacuccaucgugucguccuacgugugcagcggccuggucggggacacgccccgcaagaacgaccgguccucguccucguacugccgcaacccgaacaacgagaagggcucccacggggugaagggcugggccuucgacgacgggaacgacgucuggaugggccggaccaucggcgaggagcuccgcagcggguacgagaccuucaaggugaucggcgggugguccacccccaacucgaagcugcagaucaaccgccaggugaucgucgacuccggcaaccggagcggguacuccggcaucuucucgguggagggcaagagcugcaucaaccggugcuucuacguggagcugauccgcgggcgcgagcaggagacgcgggucugguggaccuccaacucgaucgugguguucugcggcaccuccgggaccuacggcacggggagcuggcccgacggcgccgacaucaaccucaugcccaucuga

SEQ ID NO: 24413 - RNA, 1410 nt, Artificial Sequence
  derived and/or modified CDS sequence (AUadapt) from InfluenzaA__AFG99284__NA
augaaccccaaccagaagaucaucaccaucggcucggugucccugaccaucgccacgaucugcuuccucaugcagaucgccauccuggucaccaccgugacccugcacuucaagcaguacgagugcagcuccccgcccucgaaccaggugaugcccugcgagcccaucaucaucgagcgcaacaucacgaagaucgucuaccucaccaacaccaccaucgagaaggagaucugcccgaagcugguggaguaccggaacugguccaagccccagugcaagaucacgggguucgcgcccuucagcaaggacaacuccauccgccugucggccggcggggacaucugggugacccgggagcccuacgucuccugcgacccgagcaagugcuaccaguucgcccucggccaggggaccacccugaacaacaagcacuccaacgacacgauccacgaccgcacccccuaccggacccugcucaugaacgagcugggcgugcccuuccaccugggcaccaagcaggucugcaucgccuggucguccagcuccugccacgacgggaaggccuggcuccacgugugcgugacgggccacgacgacaacgcgaccgccucguucaucuacgacgggcgccugguggacuccaucggcagcugguccaagaacauccugcggacccaggagucggagugcgucugcaucaacgggaccugcacgguggugaugaccgacggcagcgccuccgagcgcgccgacaccaagauccucuucaucgaggagggcaagaucguccacaucagcccccuguccgggucggcgcagcacguggaggagugcuccugcuacccgcgguaccccggcgugcgcugcgucugccgggacaacuggaaggggagcaaccgccccaucguggacaucaacgugaaggacuacuccaucgucucguccuacgugugcagcggccuggugggcgacacgccccggaagaacgaccgcuccucguccagcuacugccggaacccgaacaacgagaaggggucccacggcgucaaggggugggccuucgacgacggcaacgacguguggauggggcgcaccaucggcgaggagcuccggucgggcuacgagaccuucaaggucaucgggggcugguccacccccaacagcaagcugcagaucaaccgccaggugaucguggacuccaagaaccggucgggguacagcggcaucuucuccgucgagggcaagucgugcaucaaccgcugcuucuacguggagcugauccgggggcgcgagcaggagacccgcgugugguggacguccaacagcaucgucguguucugcggcaccuccgggaccuacggcaccgggagcuggcccgacggcgccgacaucaaccucaugcccaucuga

SEQ ID NO: 24414 - RNA, 1410 nt, Artificial Sequence
  derived and/or modified CDS sequence (AUadapt) from InfluenzaA__AFG99295__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacucgauccgccuguccgccggcggggacaucugggugacccgggagcccuacgucagcugcgacccggacaagugcuaccaguucgcccucggccaggggaccacgcugaacaaccgccacuccaacgacaccgugcacgaccggacccccuaccgcacccugcucaugaacgagcugggcgugcccuuccaccugggcacgaagcaggucugcaucgccuggucguccagcuccugccacgacgggaaggccuggcuccacgugugcgugaccggccacgacaagaacgcgaccgccucguucaucuacaacgggcggcuggucgacuccaucggcucgugguccaagaacauccugcgcacccaggagagcgagugcgugugcaucaacgggacgugcaccguggucaugaccgacggcuccgccucggagcgggccgacaccaagauccucuucaucgaggagggcaagaucgugcacaucagcccccuguccgggucggcgcagcacguggaggagugcuccugcuacccgcgcuaccccggcguccggugcgugugccgcgacaacuggaaggggagcaaccggcccaucguggacaucaacgucaaggacuacuccaucaucucguccuacgugugcagcggccuggugggcgacacgccccgcaagaacgaccgguccucguccucguacugccagaacccgaacaacgagaaggggucccacggcgucaaggggugggccuucgacgacggcaacgacguguggauggggcgcaccaucggcgaggagcuccggagcggcuacgagaccuucaaggucaucgggggcugguccacccccaacucgaagcugcagaucaaccgccaggugaucguggacuccgggaaccggagcggcuacuccgggaucuucucggucgagggcaagagcugcaucaaccgcugcuucuacguggagcugauccggggccgcaagcaggagacgcgcgugugguggaccuccaacucgaucgucguguucugcgggaccuccggcaccuacgggacgggcagcuggcccgacggggccgacaucaaccucaugcccaucuga

SEQ ID NO: 24415 - RNA, 1410 nt, Artificial Sequence
  derived and/or modified CDS sequence (AUadapt) from InfluenzaA__AFG99317__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaacaucaccggguucgcgcccuucuccaaggacaacucgauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggucguccagcuccugccacgacggcaaggccuggcuccacgugugcgugaccgggcacgacgagaacgcgaccgccucguucaucuacgacggccggcuggucgacuccaucgggucgugguccaagaacauccugcgcacccaggagagcgagugcgugugcaucaacggcacgugcaccguggucaugaccgacggcuccgccucggagcgggccgacaccaagauccucuucaucgaggaggggaagaucgugcacaucagcccccuguccggcucggcgcagcacguggaggagugcuccugcuacccgcgcuaccccgggguccggugcgugugccgcgacaacuggaagggcagcaaccggcccaucguggacaucaacgucaaggacuacuccaucgugucguccuacgugugcagcggccuggucggggacacgccccgcaagaacgaccgguccucguccucguacugccgcaacccgaacaacgagaagggcucccacggggugaagggcugggccuucgacgacgggaacgacgucuggaugggccggaccaucgacgaggagcuccgcagcggcuacgagaccuucaaggugaucgggggcugguccacccccaacucgaagcugcagaucaaccgccaggugaucgucgacuccgggaaccggagcggcuacuccgggaucuucucgguggagggcaagagcugcaucaaccggugcuucuacguggagcugauccgcggccgcaagcaggagacgcgggucugguggaccuccaacucgaucgugguguucugcgggaccuccggcaccuacgggacgggcagcuggcccgacggggccgacaucaaccucaugcccaucuga

SEQ ID NO: 24416 - RNA, 1410 nt, Artificial Sequence
  derived and/or modified CDS sequence (AUadapt) from InfluenzaA__AFG99328__NA
augaaccccaaccagaagaucaucaccaucggcucggugucccugacccucgccacgaucugcuuccugaugcagaucgccauccuggucaccaccgugacccuccacuucaagcaguacgagugcucguccccgcccaacaaccaggugaugcccugcgagcccacgaucaucgagcgcaacaucaccgagaucgucuaccugaccaacaccacgaucgagaaggagaucugcccgaagcugguggaguaccggaacuggagcaagccccagugcaagaucaccggguucgcgcccuucuccaaggacaacucgauccgccucuccgccggcggggacaucugggugacccgggagcccuacgucagcugcgacccguccaagugcuaccaguucgcccugggccaggggaccacgcugaacaaccgccacucgaacgacaccgugcacgaccggacccccuaccgcacccuccugaugaacgagcugggcgugcccuuccaccucggcacgcggcaggucugcauggccugguccagcuccucgugccacgacgggaaggccuggcugcacgugugcgugaccggccacgacgagaacgcgaccgccuccuucaucuacgacgggcgccuggucgacucgaucggcuccuggagcaagaacgugcuccggacccaggaguccgagugcgugugcaucaacgggacgugcaccgucgugaugaccgacggcucggccagcgagcgcgccgacaccaagauccuguucaucgaggagggcaagaucgugcacaucucgccccuguccgggaacgcgcagcacgucgaggagugcuccugcuacccgcgguaccccggcgugcgcugcgugugccgggacaacuggaaggggagcaaccgccccaucgucgacaucaacgugaaggacuacuccaucgugucguccuacgucugcagcggccucgugggcgacacgccccggaagaacgaccgcuccucguccucguacugccggaacccgaacaacgagaaggggucccacggcgucaaggggugggccuucgacgacggcaacgacguguggauggggcgcaccaucggcgaggagcugcggagcggcuacgagaccuucaaggugaucgggggcugguccacccccaacucgaagcugcagaucaaccgccaggucaucguggacuccgggaaccggagcggcuacuccgggaucuucucgguggagggcaagagcugcaucaaccgcugcuucuacgucgagcucauccgcggccggaagcaggagacgcgcgugugguggaccuccaacucgaucguggucuucugcgggaccuccggcaccuacgggacgggcagcuggcccgacggggccgacaucaaccugaugcccaucuga

SEQ ID NO: 24417 - RNA, 1410 nt, Artificial Sequence
  derived and/or modified CDS sequence (AUadapt) from InfluenzaA__AFG99350__NA
augaaccccaaccagaagaucaucaccaucggcucggugucccugacccucgccacgaucugcuuccugaugcagaucgccauccuggucaccaccgugacccuccacuucaagcaguacgagugcucguccccgcccaacaaccaggugaugcccugcgagcccacgaucaucgagcgcaacaucaccgagaucgucuaccugaccaacaccacgaucgagaaggagaucugcccgaagcugguggaguaccggaacuggagcaagccccagugcaagaucaccggguucgcgcccuucuccaaggacaacucgauccgccucuccgccggcggggacaucugggugacccgggagcccuacgucagcugcgacccguccaagugcuaccaguucgcccugggccaggggaccacgcugaacaaccgccacucgaacgacaccgugcacgaccggacccccuaccgcacccuccugaugaacgagcugggcgugcccuuccaccucggcacgcggcaggucugcauggccugguccagcuccucgugccacgacgggaaggccuggcugcacgugugcgugaccggccacgacgagaacgcgaccgccuccuucaucuacgacgggcgccuggucgacagcaucggcuccuggucgaagaacauccuccggacccaggaguccgagugcgugugcaucaacgggacgugcaccguggucaugaccgacggcagcgccucggagcgcgccgacaccaagauccuguucaucgaggagggcaagaucgugcacaucagcccccuguccggguccgcgcagcacguggaggagugcucgugcuacccgcgguaccccggcguccgcugcgugugccgggacaacuggaagggguccaaccgccccaucguggacaucaacgucaaggacuacagcaucguguccucguacgugugcuccggccucgucggcgacacgccccggaagaacgaccgcagcuccucguccuacugccggaacccgaacaacgagaaggggagccacggcgugaaggggugggccuucgacgacggcaacgacgucuggauggggcgcaccaucggcgaggagcugcgguccggcuacgagaccuucaaggugaucgggggcuggucgacccccaacuccaagcugcagaucaaccgccaggugaucgucgacagcgggaaccgguccggcuacucggggaucuucagcguggagggcaaguccugcaucaaccgcugcuucuacguggagcucauccgcggccggaagcaggagacgcgcgucugguggaccucgaacuccaucgugguguucugcgggaccagcggcaccuacgggacgggcuccuggcccgacggggccgacaucaaccugaugcccaucuga

SEQ ID NO: 24418 - RNA, 1410 nt, Artificial Sequence
  derived and/or modified CDS sequence (AUadapt) from InfluenzaA__AFG99361__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaagugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccucgugccacgacggcaaggcguggcugcacgugugcgugaccgggcacgacgagaacgccaccgccuccuucaucuacgacggccggcugguggacagcaucggguccuggucgaagaacauccuccgcacccaggaguccgagugcgucugcaucaacggcacgugcaccguggugaugaccgacggcagcgccuccgagcgggcggacaccaagauccuguucaucgaggaggggaagaucguccacaucucgccccugucgggcuccgcccagcacguggaggagugcagcugcuacccccgcuacccgggggugcggugcgucugccgcgacaacuggaagggcuccaaccggcccaucguggacaucaacgugaaggacuacucgaucgucuccagcuacgugugcuccggccucgugggggacacgccccgcaagaacgacucguccucguccagcuacugccggaaccccaacaacgagaagggcucccacggggucaagggcugggccuucgacgacgggaacgacguguggaugggccgcaccaucucggaggagcugcgguccggcuacgagaccuucaaggucaucgggggcuggagcaagccgaacuccaagcugcagaucaaccgccaggugaucguggaccgggggaaccgcucgggcuacuccgggaucuucucggucgagggcaagagcugcaucaaccggugcuucuacguggagcucauccgcggccgcaagcaggagaccgaggugugguggacguccaacucgaucgucguguucugcgggaccuccggcaccuacgggaccggcagcuggcccgacggggccgacaucaaccugaugcccaucuga

SEQ ID NO: 24419 - RNA, 1410 nt, Artificial Sequence
  derived and/or modified CDS sequence (AUadapt) from InfluenzaA__AFG99383__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacucgauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggucguccagcuccugccacgacggcaaggccuggcuccacgugugcgugaccgggcacgacgagaacgcgaccgccucguucaucuacgacggccggcuggucgacuccaucgggagcugguccaagaacauccugcgcacccaggagucggagugcgugugcaucaacggcacgugcaccguggucaugaccgacggcuccgccagcgagcgggccgacaccaagauccucuucaucgaggaggggaagaucgugcacaucucgccccuguccggcagcgcgcagcacguggaggagugcuccugcuacccgcgcuaccccgggguccggugcgugugccgcgacaacuggaagggcucgaaccggcccaucguggacaucaacgucaaggacuacuccaucgugagcuccuacgugugcucgggccuggucggggacacgccccgcaagaacgacuccagcuccucguccuacugccggaacccgaacaacgagaagggcagccacggggugaagggcugggccuucgacgacgggaacgacgucuggaugggccgcaccaucggcgaggagcuccgguccggguacgagaccuucaaggugaucggcggguggucgacccccaacuccaagcugcagaucaaccgccaggugaucgucgacagcggcaaccgguccggguacucgggcaucuucagcguggagggcaaguccugcaucaaccgcugcuucuacguggagcugauccgggggcgcaagcaggagacgaaggucugguggaccucgaacuccaucgugguguucugcggcaccagcgggaccuacggcacgggguccuggcccgacggcgccgacaucaaccucaugcccaucuga

SEQ ID NO: 24420 - RNA, 1410 nt, Artificial Sequence; identical to SEQ ID NO: 24419
  derived and/or modified CDS sequence (AUadapt) from InfluenzaA__AFG99394__NA

SEQ ID NO: 24421 - RNA, 1410 nt, Artificial Sequence
  derived and/or modified CDS sequence (AUadapt) from InfluenzaA__AFG99405__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacucgauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggucguccagcuccugccacgacggcaaggccuggcuccacgugugcgugaccgggcacgacaagaacgcgaccgccucguucaucuacgacggccggcuggucgacuccaucgggucgugguccaagaacauccugcgcacccaggagagcgagugcgugugcaucaacggcacgugcaccguggucaugaccgacggcuccgccucggagcgggccgacaccaagauccucuucaucgaggaggggaagaucgugcacaucagcccccuguccggcucggcgcagcacguggaggagugcuccugcuacccgcgcuaccccgggguccggugcgugugccgcgacaacuggaagggcagcaaccggcccaucguggacaucaacgucaaggacuacuccaucaucucguccuacgugugcagcggccuggugggggacacgccccgcaagaacgaccgguccucguccucguacugccgcaacccgaacaacgagaagggcucccacggggucaagggcugggccuucgacgacgggaacgacguguggaugggccggaccaucggcgaggagcuccgcagcggguacgagaccuucaaggucaucggcgggugguccacccccaacucgaagcugcagaucaaccgccaggugaucguggacuccggcaaccggagcggguacuccggcaucuucucggucgagggcaagagcugcaucaaccggugcuucuacguggagcugauccgcgggcgcgagcaggagacgcgggugugguggaccuccaacucgaucgucguguucugcggcaccuccgggaccuacggcacggggagcuggcccgacggcgccgacaucaaccucaugcccaucuga

SEQ ID NO: 24422 - RNA, 1410 nt, Artificial Sequence
  derived and/or modified CDS sequence (AUadapt) from InfluenzaA__AFG99416__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacucgauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggucguccagcuccugccacgacggcaaggccuggcuccacgugugcgugaccgggcacgacgagaacgcgaccgccucguucaucuacgacggccggcuggucgacuccaucgggucgugguccaagaacauccugcgcacccaggagagcgagugcgugugcaucaacggcacgugcaccguggucaugaccgacggcuccgccucggagcgggccgacaccaagauccucuucaucgaggaggggaagaucauccacaucagcccccuguccggcucggcgcagcacguggaggagugcuccugcuacccgcgcuaccccggggugcggugcgucugccgcgacaacuggaagggcagcaaccggcccaucguggacaucaacgugaaggacuacuccaucgucucguccuacgugugcagcggccuggugggggacacgccccgcaagaacgacuccucguccucguccuacugccggaacccgaacaacgagaagggcagccacggggucaagggcugggccuucgacgacgggaacgacguguggaugggccgcaccaucggcgaggagcuccgguccggguacgagaccuucaaggucaucggcggguggucgacccccaacuccaagcugcagaucaaccgccaggugaucguggacggcgggaaccggagcggcuacuccggcaucuucucggucgagggcaagagcugcaucaaccgcugcuucuacguggagcugauccgggggcgcaagcaggagacgaaggugugguggaccuccaacucgaucgucguguucugcgggaccuccggcaccuacgggacgggcagcuggcccgacggcgccgacaucaaccucaugcccaucuga

SEQ ID NO: 24423 - RNA, 1410 nt, Artificial Sequence
  derived and/or modified CDS sequence (AUadapt) from InfluenzaA__AFG99427__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccacgaucaucgagcgcaacaucaccgagaucgucuaccucaccaacaccacgaucgagaaggaggugugcccgaagcugguggaguaccggaacuggagcaagccccagugcaagaucaccggguucgcgcccuucuccaaggacaacucgauccgccuguccgccggcggggacaucugggucacccgggagcccuacgugagcugcgacccgggcaagugcuaccaguucgcccucgggcagggcaccacgcugaacaaccgccacuccaacgacaccgugcacgaccggacccccuaccgcacccugcucaugaacgagcugggcguccccuuccaccuggggacgaagcaggucugcaucgccuggucguccagcuccugccacgacggcaaggccuggcuccacgugugcgugaccgggcacgacgagaacgcgaccgccucguucaucuacgacggccggcugguggacuccaucgggagcugguccaagaacauccugcgcacccaggagucggagugcgugugcaucaacggcacgugcaccgucgugaugaccgacggcuccgccagcgagcgggccgacaccaagauccucuucaucgaggaggggaagaucauccacaucucgccccuguccggcagcgcgcagcacguggaggagugcuccugcuacccgcgcuaccccgggguccggugcgugugccgcgacaacuggaagggcucgaaccggcccaucguggacaucaacgucaaggacuacuccaucgugagcuccuacgugugcucgggccuggucggggacacgccccgcaagaacgacuccagcuccucguccuacugccggaacccgaacaacgagaagggcagccacggggugaagggcugggccuucgacgacgggaacgacgucuggaugggccgcaccaucggcgaggagcuccgguccggguacgagaccuucaaggugaucggcggguggucgacccccaacuccaagcugcagaucaaccgccaggugaucgucgacagcggcaaccgguccggguacucgggcaucuucagcguggagggcaaguccugcaucaaccgcugcuucuacguggagcugauccgggggcgcaagcaggagacgaaggucugguggaccucgaacuccaucgugguguucugcggcaccagcgggaccuacggcacgggguccuggcccgacggcgccgacaucaaccucaugcccaucuga

SEQ ID NO: 24424 - RNA, 1410 nt, Artificial Sequence
  derived and/or modified CDS sequence (AUadapt) from InfluenzaA__AFG99438__NA
augaaccccaaccagaagaucaucaccaucggcucggugucccugaccaucgccacgaucugcuuccucaugcagaucgccauccuggucaccaccgugacccugcacuuccgccaguacgagugcucguccccgcccaacaaccaggugaugcccugcgagcccacgaucaucgagcggaacaucaccgagaucgucuaccucaccaacaccacgaucgagaaggagaucugcccgaagcugguggaguaccgcaacuggagcaagccccagugcaagaucaccggguucgcgcccuucuccaaggacaacucgauccggcuguccgccggcggggacaucugggugacccgcgagcccuacgucagcugcgacccgggcaagugcuaccaguucgcccucgggcagggcaccacgcugaacaaccggcacuccaacgacaccgugcacgaccgcacccccuaccggacccugcucaugaacgagcugggcgugcccuuccaccuggggacgaagcaggucugcauggccuggucguccagcuccugccacgacggcaaggccuggcuccacgugugcgugaccgggcacgacgagaacgcgaccgccucguucaucuacgacggccgccuggucgacuccaucgggucgugguccaagaacauccugcggacccaggagagcgagugcgugugcaucaacggcacgugcaccguggucaugaccgacggcuccgccucggagcgcgccgacaccaagauccucuucaucgaggaggggaagaucgugcacaucagcccccuguccggcucggcgcagcacguggaggagugcuccugcuacccgcgguaccccgggguccgcugcgugugccgggacaacuggaagggcagcaaccgccccaucguggacaucaacgucaaggacuacuccaucgugucguccuacgugugcagcggccuggucggggacacgccccggaagaacgaccgcuccucguccucguacugccggaacccgaacaacgagaagggcucccacggggugaagggcugggccuucgacgacgggaacgacgucuggaugggccgcaccaucggcgaggagcuccggagcggguacgagaccuucaaggugaucggcgggugguccacccccaacucgaagcugcagaucaaccgccaggugaucgucgacuccggcaaccggagcggguacuccggcaucuucucgguggagggcaagagcugcaucaaccgcugcuucuacguggagcugauccgcgggcggaagcaggagacgcgcgucugguggaccuccaacucgaucgugguguucugcggcaccuccgggaccuacggcacggggagcuggcccgacggcgccgacaucaaccucaugcccaucuga

SEQ ID NO: 24425 - RNA, 1410 nt, Artificial Sequence
  derived and/or modified CDS sequence (AUadapt) from InfluenzaA__AFG99449__NA
augaaccccaaccagaagaucaucaccaucggcucggugucccugaccaucgccacgaucugcuuccucaugcagaucgccauccuggucaccaccgugacccugcacuuccgccaguacgagugcucguccccgcccaacaaccaggugaugcccugcgagcccacgaucaucgagcggaacaucaccgagaucgucuaccucaccaacaccacgaucgagaaggagaucugcccgaagcugguggaguaccgcaacuggagcaagccccagugcaagaucaccggguucgcgcccuucuccaaggacaacucgauccggcuguccgccggcggggacaucugggugacccgcgagcccuacgucagcugcgacccgggcaagugcuaccaguucgcccucgggcagggcaccacgcugaacaaccggcacuccaacgacaccgugcacgaccgcacccccuaccggacccugcucaugaacgagcugggcgugcccuuccaccuggggacgaagcaggucugcauggccuggucguccucguccugccacgacggcaaggccuggcuccacgugugcgugaccgggcacgacgagaacgcgaccgccagcuucaucuacgacggccgccuggucgacuccaucgggucgugguccaagaacauccugcggacccaggagagcgagugcgugugcaucaacggcacgugcaccguggucaugaccgacggcuccgccucggagcgcgccgacaccaagauccucuucaucgaggaggggaagaucgugcacaucagcccccuguccggcucggcgcagcacguggaggagugcuccugcuacccgcgguaccccgggguccgcugcgugugccgggacaacuggaagggcucgaaccgccccaucguggacaucaacgucaaggacuacuccaucgugagcuccuacgugugcucgggccuggucggggacacgccccggaagaacgaccgcuccagcuccucguacugccggaacccgaacaacgagaagggcucccacggggugaagggcugggccuucgacgacgggaacgacgucuggaugggccgcaccaucggcgaggagcuccggucgggguacgagaccuucaaggugaucggcgggugguccacccccaacagcaagcugcagaucaaccgccaggugaucgucgacuccggcaaccggucgggguacuccggcaucuucagcguggagggcaagaacugcaucaaccgcugcuucuacguggagcugauccgcgggcggaagcaggagacgcgcgucugguggaccucgaacuccaucgugguguucugcggcaccagcgggaccuacggcacgggguccuggcccgacggcgccgacaucaaccucaugcccaucuga

SEQ ID NO: 24426 - RNA, 1410 nt, Artificial Sequence
  derived and/or modified CDS sequence (AUadapt) from InfluenzaA__AFG99471__NA
augaaccccaaccagaagaucaucaccaucggcucggugucccugauccucgccaccaucugcuuccugaugcagaucgccauccuggucacgaccgugacccuccacuucaagcaguacgagugcucguccccgcccaacaaccaggugaugcccugcgagcccaccaucaucgagcgcaacaucacggagaucgucuaccugaccaacaccaccaucgagaaggagaucugcccgaagcugguggaguaccggaacuggagcaagccccagugcaagaucacgggguucgcgcccuucuccaaggacaacucgauccgccucuccgccggcggggacaucugggugacccgggagcccuacgucagcugcgacccgggcaagugcuaccaguucgcccuggggcagggcaccacccugaacaaccgccacuccaacgacacggugcacgaccggaaccccuaccgcacccuccugaugaacgagcugggcgugcccuuccaccucgggacccggcaggucugcauggccuggucguccagcuccugccacgacggcaaggccuggcugcacgugugcgugaccgggcacgacgagaacgcgacggccucguucaucuacgacggccgccuggucgacuccaucgggagcugguccaagaacauccuccggacccaggagucggagugcgugugcaucaacgggaccugcaccguggucaugacggacggcuccgccagcgagcgcgccgacaccaagauccuguucaucgaggagggcaagaucgugcacaucucgccccuguccggcagcgcgcagcacguggaggagugcuccugcuacccgcgguaccccgggguccgcugcgugugccgggacaacuggaagggcucgaaccgccccaucguggacaucaacgucaaggacuacuccaucgugagcuccuacgugugcucgggccucgucggggacacgccccggaagaacgaccgcuccagcuccucguacugccggaacccgaacaacgagaagggcucccacggggugaagggcugggccuucgacgacgggaacgacgucuggaugggccgcaccaucggcgaggagcugcggagcggguacgagaccuucaaggugaucggcgggugguccacccccaacucgaagcugcagaucaaccgccaggugaucgucgacuccggcaaccggagcggguacuccggcaucuucucgguggagggcaagagcugcaucaaccgcugcuucuacguggagcucauccgcgggcggaagcaggagacccgcgucugguggaccuccaacucgaucgugguguucugcggcacguccgggaccuacggcaccgggagcuggcccgacggcgccgacaucaaccugaugcccaucuga

SEQ ID NO: 24427 - RNA, 1410 nt, Artificial Sequence
  derived and/or modified CDS sequence (AUadapt) from InfluenzaA__AFG99482__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcccugcgagcccacgaucaucgagcgcaacaucaccgagaucgucuaccucaccaacaccacgaucgagaaggagaucugcccgaagcugguggaguaccggaacugguccaagccccagugcaagaucaccggguucgcgcccuucagcaaggacaacuccauccgccugucggccggcggggacaucugggugacccgggagcccuacgucuccugcgacccgggcaagugcuaccaguucgcccucgggcagggcaccacgcugaacaaccgccacagcaacgacaccgugcacgaccggacccccuaccgcacccugcucaugaacgagcugggcgugcccuuccaccuggggacgaagcaggucugcaucgccugguccucguccucgugccacgacggcaaggccuggcuccacgugugcgugaccgggcacgacgagaacgcgaccgccuccuucaucuacgacggccggcuggucgacagcaucggguccuggucgaagaacauccugcgcacccaggaguccgagugcgugugcaucaacggcacgugcaccguggucaugaccgacggcagcgccuccgggcgggccgacaccaagauccucuucaucgaggagggcaagaucgugcacaucucgccccugagcggguccgcgcagcacguggaggagugcucgugcuacccgcgcuaccccggcguccggugcgugugccgcgacaacuggaagggcuccaaccggcccaucguggacaucaacgucaaggacuacucgaucguguccagcuacgugugcuccgggcuggucggcgacacgccccgcaagaacgacucguccagcuccucguacugccggaacccgaacaacgagaaggggucccacggcgugaaggggugggccuucgacgacggcaacgacgucuggaugggccgcaccaucggggaggagcuccggucgggcuacgagaccuucaaggugaucgggggcugguccacccccaacagcaagcugcagaucaaccgccaggugaucgucgaccgggggaaccgcuccggcuacucgggcaucuucuccguggaggggaagaacugcaucaaccggugcuucuacguggagcugauccgcggccgcaagcaggagacgaaggucugguggaccagcaacucgaucgugguguucugcgggaccuccggcaccuacgggacgggcagcuggcccgacggcgccgacaucaaccucauguccaucuga

SEQ ID NO: 24428 - RNA, 1410 nt, Artificial Sequence
  derived and/or modified CDS sequence (AUadapt) from InfluenzaA__AFG99493__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcccugcgagcccacgaucaucgagcgcaacaucaccgagaucgucuaccucaccaacaccacgaucgagaaggagaucugcccgaagcugguggaguaccggaacugguccaagccccagugcaagaucaccggguucgcgcccuucagcaaggacaacuccauccgccugucggccggcggggacaucugggugacccgggagcccuacgucuccugcgacccgggcaagugcuaccaguucgcccucgggcagggcaccacgcugaacaaccgccacagcaacgacaccgugcacgaccggacccccuaccgcacccugcucaugaacgagcugggcgugcccuuccaccuggggacgaagcaggucugcaucgccugguccucguccucgugccacgacggcaaggccuggcuccacgugugcgugaccgggcacgacgagaacgcgaccgccuccuucaucuacgacggccggcuggucgacagcaucggguccuggucgaagaacauccugcgcacccaggaguccgagugcgugugcaucaacggcacgugcaccguggucaugaccgacggcagcgccuccgggcgggccgacaccaagauccucuucaucgaggagggcaagaucgugcacaucucgccccugagcggguccgcgcagcacguggaggagugcucgugcuacccgcgcuaccccggcguccggugcgugugccgcgacaacuggaagggcuccaaccggcccaucguggacaucaacgucaaggacuacucgaucguguccagcuacgugugcuccgggcuggucggcgacacgccccgcaagaacgacucguccagcuccucguacugccggaacccgaacaacgagaaggggucccacggcgugaaggggugggccuucgacgacggcaacgacgucuggaugggccgcaccaucggggaggagcuccggucgggcuacgagaccuucaaggugaucgggggcugguccacccccaacagcaagcugcagaucaaccgccaggugaucgucgaccgggggaaccgcuccggcuacucgggcaucuucuccguggagggcaagagcugcaucaaccggugcuucuacguggagcugauccgcgggcgcaagcaggagacgaaggucugguggaccucgaacuccaucgugguguucugcgggaccagcggcaccuacgggacgggcuccuggcccgacggcgccgacaucaaccucaugcccaucuga

SEQ ID NO: 24429 - RNA, 1410 nt, Artificial Sequence
  derived and/or modified CDS sequence (AUadapt) from InfluenzaA__AFG99504__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacucgauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggucguccagcuccugccacgacggcaaggccuggcuccacgugugcgugaccgggcacgacgagaacgcgaccgccucguucaucuacgacggccggcuggucgacuccaucgggucgugguccaagaacauccugcgcacccaggagagcgagugcgugugcaucaacggcacgugcaccguggucaugaccgacggcuccgccucggagcgggccgacaccaagauccucuucaucgaggaggggaagaucgugcacaucagcccccuguccggcucggcgcagcacguggaggagugcuccugcuacccgcgcuaccccgggguccggugcgugugccgcgacaacuggaagggcagcaaccggcccaucguggacaucaacgucaaggacuacuccaucgugucguccuacgugugcagcggccuggucggggacacgccccgcaagaacgaccgguccucguccucguacugccgcaacccgaacaacgagaagggcucccacggggugaagggcugggccuucgacgacgggaacgacgucuggaugggccggaccaucggcgaggagcuccgcagcggguacgagaccuucaaggugaucggcgggugguccacccccaacucgaagcugcagaucaaccgccaggugaucgucgacuccggcaaccggagcggguacuccggcaucuucucgguggagggcaagagcugcaucaaccggugcuucuacguggagcugauccgcgggcgcaagcaggagacgcgggucugguggaccuccaacucgaucgugguguucugcggcaccuccgggaccuacggcacggggagcuggcccgacggcgccgacaucaaccucaugcccaucuga

SEQ ID NO: 24430 - RNA, 1410 nt, Artificial Sequence
  derived and/or modified CDS sequence (AUadapt) from InfluenzaA__AFG99515__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccucgugccacgacggcaaggcguggcugcacgugugcgugaccgggcacgacgagaacgccaccgccuccuucaucuacgacggccggcugguggacagcaucggguccuggucgaagaacauccuccgcacccaggaguccgagugcgucugcaucaacggcacgugcaccguggugaugaccgacggcagcgccuccgagcgggcggacaccaagauccuguucaucgaggaggggaagaucguccacaucucgccccugagcggcuccgcccagcacguggaggagugcucgugcuacccccgcuacccgggggugcggugcgucugccgcgacaacuggaagggcuccaaccggcccaucguggacaucaacgugaaggacuacucgaucgucuccagcuacgugugcuccggccucgugggggacacgccccgcaagaacgacucguccagcuccucguacugccggaaccccaacaacgagaagggcucccacggggucaagggcugggccuucgacgacgggaacgacguguggaugggccgcaccaucggcgaggagcugcggucgggguacgagaccuucaaggucaucggcgggugguccaccccgaacagcaagcugcagaucaaccgccaggugaucguggaccggggcaaccgcuccggguacucgggcaucuucuccgucgagggcaagagcugcaucaaccggugcuucuacguggagcucauccgcgggcgcaagcaggagacggaggugugguggaccucgaacuccaucgucguguucugcggcaccagcgggaccuacggcacgggguccuggcccgacggcgccgacaucaaccugaugcccaucuga

SEQ ID NO: 24431 - RNA, 1410 nt, Artificial Sequence
  derived and/or modified CDS sequence (AUadapt) from InfluenzaA__AFG99526__NA
augaaccccaaccagaagaucaucaccaucggcucggugucccugacccucgccacgaucugcuuccugaugcagaucgccauccuggucaccaccgugacccuccacuucaagcaguacgagugcucguccccgcccaacaaccaggugaugcccugcgagcccacgaucaucgagcgcaacaucaccgagaucgucuaccugaccaacaccacgaucgagaaggaggugugcccgaagcugguggaguaccggaacuggagcaagccccagugcaagaucaccggguucgcgcccuucuccaaggacaacucgauccgccucuccgccggcggggacaucugggucacccgggagcccuacgugagcugcgacccgggcaagugcuaccaguucgcccuggggcagggcaccacgcugaacaaccgccacuccaacgacaccgugcacgaccggacccccuaccgcacccuccugaugaacgagcugggcguccccuuccaccucgggacgcgccaggugugcauggccuggucguccagcuccugccacgacggcaaggccuggcugcacgugugcgucaccgggcacgacgagaacgcgaccgccucguucaucuacgacggccggcugguggacuccaucgggucgugguccaagaacauccuccggacccaggagagcgagugcgugugcaucaacggcacgugcaccgucgugaugaccgacggcuccgccucggggcgcgccgacaccaagauccuguucaucgaggagggcaagaucgugcacaucagcccccuguccgggucggcgcagcacgucgaggagugcuccugcuacccgcgguaccccggcgugcgcugcgugugccgggacaacuggaagggcagcaaccgccccaucgucgacaucaacgugaaggacuacuccaucgugucguccuacgucugcagcgggcucgugggcgacacgccccggaagaacgaccgcuccucguccucguacugccggaacccgaacaacgagaaggggucccacggcgucaaggggugggccuucgacgacggcaacgacguguggaugggccgcaccaucggggaggagcugcggagcggcuacgagaccuucaaggugaucgggggcugguccacccccaacucgaagcugcagaucaaccgccaggucaucguggacuccgggaaccggagcggcuacuccggcaucuucucgguggagggcaagagcugcaucaaccgcugcuucuacgucgagcucauccgcgggcggaagcaggagacgcgcgugugguggaccuccaacucgaucguggucuucugcgggaccuccggcaccuacgggacgggcagcuggcccgacggcgccgacaucaaccugaugcccaucuga

SEQ ID NO: 24432 - RNA, 1410 nt, Artificial Sequence; identical to SEQ ID NO: 24328
  derived and/or modified CDS sequence (AUadapt) from InfluenzaA__AFG99537__NA

SEQ ID NO: 24433 - RNA, 1410 nt, Artificial Sequence; identical to SEQ ID NO: 24328
  derived and/or modified CDS sequence (AUadapt) from InfluenzaA__AFG99548__NA

SEQ ID NO: 24434 - RNA, 1410 nt, Artificial Sequence; identical to SEQ ID NO: 24328
  derived and/or modified CDS sequence (AUadapt) from InfluenzaA__AFG99559__NA

SEQ ID NO: 24435 - RNA, 1410 nt, Artificial Sequence; identical to SEQ ID NO: 24328
  derived and/or modified CDS sequence (AUadapt) from InfluenzaA__AFG99570__NA

SEQ ID NO: 24436 - RNA, 1410 nt, Artificial Sequence; identical to SEQ ID NO: 24328
  derived and/or modified CDS sequence (AUadapt) from InfluenzaA__AFG99581__NA

SEQ ID NO: 24437 - RNA, 1410 nt, Artificial Sequence
  derived and/or modified CDS sequence (AUadapt) from InfluenzaA__AFG99592__NA
augaaccccaaccagaagaucaucaccaucggcucggugucccugaccaucgccacgaccugcuuccucaugcagaucgccauccuggucaccaccgugacgcugcacuucaagcaguacgagugcaacucgccgcccaacaaccaggugaugcccugcgagcccaccaucaucgagcgcaacaucaccgagaucgucuaccucaccaacacgaccaucgagaaggagaucugcccgaagcugguggaguaccggaacugguccaagccccagugcaagaucaccggguucgcgcccuucagcaaggacaacuccauccgccugucggccggcggggacaucugggugacccgggagcccuacgucuccugcgacccgggcaagugcuaccaguucgcccucgggcagggcacgacccugaacaaccgccacucgaacgacaccgugcacgaccggacccccuaccgcacgcugcucaugaacgagcugggcgugcccuuccaccuggggaccaagcaggucugcaucgccugguccagcuccucgugccacgacggcaaggccuggcuccacgugugcgugaccgggcacgacgagaacgcgaccgccuccuucaucuacgacggccggcuggucgacagcaucguguccuggucgaagaacauccugcgcacgcaggaguccgagugcgugugcaucaacgggaccugcaccgucgugaugaccgacggcucggccuccgagcgggccgacacgaagauccucuucaucgaggagggcaagaucgugcacaucagcccccugucgggguccgcgcagcacgucgaggagugcucgugcuacccgcgcuaccccggcgugcggugcgugugccgcgacaacuggaagggguccaaccggcccaucgucgacaucaacgugaaggacuacagcaucguguccucguacgucugcuccggccuggugggcgacacgccccgcaagaacgacagcuccucguccucguacugccggaacccgaacaacgagaaggggucccacggcgucaaggggugggccuucgacgacggcaacgacguguggauggggcgcaccaucggcgaggagcuccggagcggcuacgagaccuucaaggugaucgggggcugguccacccccaacucgaagcugcagaccaaccgccaggucaucguggaccgggggaaccgcuccggcuacucggggaucuucuccguggagggcaagagcugcaucaaccggugcuucuacgucgagcugauccgcggccgcaagcaggagaccaaggugugguggaccucgaacuccaucguggucuucugcgggacgagcggcaccuacgggaccggcuccuggcccgacggggccgacaucaaccucaugcccaucuga

SEQ ID NO: 24438 - RNA, 1410 nt, Artificial Sequence; identical to SEQ ID NO: 24328
  derived and/or modified CDS sequence (AUadapt) from InfluenzaA__AFG99603__NA

SEQ ID NO: 24439 - RNA, 1410 nt, Artificial Sequence; identical to SEQ ID NO: 24328
  derived and/or modified CDS sequence (AUadapt) from InfluenzaA__AFG99614__NA

SEQ ID NO: 24440 - RNA, 1410 nt, Artificial Sequence; identical to SEQ ID NO: 24328
  derived and/or modified CDS sequence (AUadapt) from InfluenzaA__AFG99625__NA

SEQ ID NO: 24441 - RNA, 1410 nt, Artificial Sequence
  derived and/or modified CDS sequence (AUadapt) from InfluenzaA__AFG99636__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccucgugccacgacggcaaggcguggcugcacgugugcgugaccgggcacgacgagaacgccaccgccuccuucaucuacgacggccggcugguggacagcaucgucuccuggucgaagaacauccuccgcacccaggaguccgagugcgugugcaucaacgggacgugcaccguggucaugaccgacggcagcgccuccgagcgggcggacaccaagauccuguucaucgaggagggcaagaucgugcacaucucgccccugagcggguccgcccagcacguggaggagugcucgugcuacccccgcuacccgggcguccggugcgugugccgcgacaacuggaagggguccaaccggcccaucguggacaucaacgucaaggacuacucgaucguguccagcuacgugugcuccggccucgucggcgacacgccccgcaagaacgacucguccagcuccucguacugccggaaccccaacaacgagaaggggucccacggcgugaaggggugggccuucgacgacggcaacgacgucuggauggggcgcaccaucggcgaggaccugcggucgggcuacgagaccuucaaggugaucgggggcugguccaccccgaacagcaagcugcagacgaaccgccaggugaucgucgaccgggggaaccgcuccggcuacucggggaucuucuccguggagggcaagagcugcaucaaccggugcuucuacguggagcucauccgcggccgcaagcaggagaccaaggucugguggaccucgaacuccaucgugguguucugcgggaccagcggcacguacgggaccggcuccuggcccgacggggccgacaucaaccugaugcccaucuga

SEQ ID NO: 24442 - RNA, 1410 nt, Artificial Sequence
  derived and/or modified CDS sequence (AUadapt) from InfluenzaA__AFG99658__NA
augaaccccaaccagaagaucaucaccaucggcucggugucccugaccaucgccacgaucugcuuccucaugcagaucaccauccuggucaccaccgugacgcugcacuucaagcaguacgagugcaacagcccgcccaacaaccaggugaugcucugcgagcccaccaucaucgagcgcaacaucaccgagaucgucuaccugaccaacacgaccaucgagaaggagaucugccccaagcugguggaguaccggaacugguccaagccgcagugcaagaucaccggguucgcccccuucucgaaggacaacuccauccgccucagcgcgggcggggacaucugggugacccgggagcccuacgucuccugcgaccccggcaagugcuaccaguucgcccuggggcagggcacgacccugaacaaccgccacucgaacgacaccgugcacgaccggaccccguaccgcacgcuccugaugaacgagcugggcgugcccuuccaccucgggaccaagcaggucugcaucgccugguccagcuccucgugccacgacggcaaggccuggcugcacgugugcgugaccgggcacgacgagaacgccaccgcguccuucaucuacgacggccggcuggucgacagcaucuccucgugguccaagaacauccuccgcacgcaggagagcgagugcgugugcaucaacgggaccugcaccguggucaugaccgacggcuccgccucggagcgggccgacacgaagauccuguucaucgaggagggcaagaucgugcacaucagcccccuguccgggucggcccagcacguggaggagugcuccugcuacccccgcuacccgggcguccggugcgugugccgcgacaacuggaaggggagcaaccggcccaucguggacaucaacgucaaggacuacuccaucgugucguccuacgugugcagcggccucgucggcgacacgccccgcaagaacgacuccucguccagcuccuacugccggaaccccaacaacgagaaggggucgcacggcgugaaggggugggcguucgacgacggcaacgacgucuggauggggcgcaccaucuccgaggagcugcggagcggcuacgagaccuucaaggugaucggcgggugguccaccccgaacucgaagcugcagaucaaccgccaggugaucgucgaccggggcaaccgcuccggguacagcggcaucuucucgguggaggggaaguccugcaucaaccggugcuucuacguggagcucauccgcggccgcaagcaggagaacaaggucugguggaccagcaacuccaucgugguguucugcggcaccagcgggaccuacggcacgggguccuggcccgacggcgccgacaucaaccugaugcccaucuga

SEQ ID NO: 24443 - RNA, 1410 nt, Artificial Sequence
  derived and/or modified CDS sequence (AUadapt) from InfluenzaA__AFG99680__NA
augaaccccaaccagaagaucaucaccaucggcucggugucccugaccaucgccacgaucugcuuccucaugcagaucgccauccuggucaccaccgugacccugcacuucaagcaguacgagugcagcuccccgcccaacaaccaggugauccucugccagcccacgaucaucgagcgcaacaucaccgagaucgucuaccugaccaacaccacgaucgagaaggagaucugccccaagcugguggaguaccggaacuggucgaagccgcagugcaagaucaccggguucgcgcccuucuccaaggacaacagcauccgccucuccgccggcggggacaucugggugacccgggagcccuacgucucgugcgaccccuccaagugcuaccaguucgcccugggccaggggaccacgcugaacaaccgccacagcaacgacaccgugcacgaccggaccccguaccgcacccuccugaugaacgagcugggcgugcccuuccaccucggcacgaagcaggucugcaucgccugguccagcuccucgugccacgacgggaaggccuggcugcacgugugcgugaccggccacgacgagaacgcgaccgccuccuucaucuacgacgggcggcuggucgacagcaucggcuccuggucgaagaacauccuccgcacccaggaguccgagugcgugugcaucaacgggacgugcaccguggucaugaccgacggcagcgccucggagcgggccgacaccaagauccuguucaucgaggagggcaagguggugcacaucagcccccuguccggguccgcgcagcacgucgaggagugcagcugcuacccccgcuacccgggcgugcggugcgugugccgcgacaacuggaagggguccaaccggcccaucgucgacaucaacgugaaggacuacucgaucguguccagcuacgucugcuccggccucgugggcgacacgccccgcaagaacgacucguccagcuccucguacugccggaaccccaacaacgagaaggggucccacggcgucaaggggugggccuucgacgacggcaacgacguguggauggggcgcaccaucagcgaggagcugcgguccggcuacgagaccuucaaggugaucggcggguggagcaccccgaacuccaagcugcagaucaaccgccaggucaucguggacucgggcaaccggagcggguacuccggcaucuucucgguggaggggaaguccugcaucaaccgcugcuucuacgucgagcucauccggggccgcaagcaggagacgaaggugugguggaccagcaacuccaucguggucuucugcggcaccagcgggaccuacggcacgggguccuggcccgacggcgccgacaucaaccugaugcccaucuga

SEQ ID NO: 24444 - RNA, 1410 nt, Artificial Sequence
  derived and/or modified CDS sequence (AUadapt) from InfluenzaA__AFG99691__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcccugcgagcccacgaucaucgagcgcaacaccaccgagaucgucuaccucaccaacacgaccaucgagaaggagaucugcccgaagcugguggaguaccggaacugguccaagccccagugcaagaucaccggguucgcgcccuucagcaaggacaacuccauccgccugucggccggcggggacaucugggugacccgggagcccuacgucuccugcgacccgggcaagugcuaccaguucgcccucgggcagggcacgacccugaacaaccgccacucgaacgacaccgugcacgaccggacccccuaccgcacgcugcucaugaacgagcugggcgugcccuuccaccuggggaccaagcaggucugcaucgccugguccagcuccucgugccacgacggcaaggccuggcuccacgugugcgugaccgggcacgacgagaacgcgaccgccuccuucaucuacgacggccggcuggucgacagcaucguguccuggucgaagaacauccugcgcacgcaggaguccgagugcgugugcaucaacgggaccugcaccgucgugaugaccgacggcucggccuccgagcgggccgacacgaagauccucuucaucgaggagggcaagaucgugcacaucagcccccugucgggguccgcgcagcacgucgaggagugcucgugcuacccgcgcuaccccggcgugcggugcgugugccgcgacaacuggaagggguccaaccggcccaucgucgacaucaacgugaaggacuacagcaucguguccucguacgucugcuccggccuggugggcgacacgccccgcaagaacgacagcuccucguccucguacugccggaacccgaacaacgagaaggggucccacggcgucaaggggugggccuucgacgacggcaacgacguguggauggggcgcaccaucggcgaggagcuccggagcggcuacgagaccuucaaggugaucgggggcugguccacccccaacucgaagcugcagaccaaccgccaggucaucguggaccgggggaaccgcuccggcuacucggggaucuucuccguggagggcaagagcugcaucaaccggugcuucuacgucgagcugauccgcggccgcaagcaggagaccaaggugugguggaccucgaacuccaucguggucuucugcgggacgagcggcaccuacgggaccggcuccuggcccgacggggccgacaucaaccucaugcccaucuga

SEQ ID NO: 24445 - RNA, 1410 nt, Artificial Sequence; identical to SEQ ID NO: 24328
  derived and/or modified CDS sequence (AUadapt) from InfluenzaA__AFG99704__NA

SEQ ID NO: 24446 - RNA, 1410 nt, Artificial Sequence; identical to SEQ ID NO: 24328
  derived and/or modified CDS sequence (AUadapt) from InfluenzaA__AFG99715__NA

SEQ ID NO: 24447 - RNA, 1410 nt, Artificial Sequence; identical to SEQ ID NO: 24328
  derived and/or modified CDS sequence (AUadapt) from InfluenzaA__AFG99726__NA

SEQ ID NO: 24448 - RNA, 1410 nt, Artificial Sequence
  derived and/or modified CDS sequence (AUadapt) from InfluenzaA__AFG99737__NA
augaaccccaaccagaagaucaucaccaucggcucggugucccugaccaucgccacgaucugcuuccucaugcagaucaccauccuggucaccaccgugacgcugcacuucaagcaguacgagugcaacucgccgcccaacaaccaggugaugcucugcgagcccaccaucaucgagcgcaacaucaccgagaucgucuaccugaccaacacgaccaucgagaaggagaucugccccaagcugguggaguaccggaacugguccaagccgcagugcaagaucaccggguucgcccccuucagcaaggacaacuccauccgccucucggcgggcggggacaucugggugacccgggagcccuacgucuccugcgaccccggcaagugcuaccaguucgcccuggggcagggcacgacccugaacaaccgccacagcaacgacaccgugcacgaccggaccccguaccgcacgcuccugaugaacgagcugggcgugcccuuccaccucgggaccaagcaggucugcaucgccugguccucguccagcugccacgacggcaaggccuggcugcacgugugcgugaccgggcacgacgagaacgccaccgcguccuucaucuacgacggccggcuggucgacucgaucggguccuggagcaagaacauccuccgcacgcaggaguccgagugcgugugcaucaacgggaccugcaccguggucaugaccgacggcucggccuccgagcgggccgacacgaagauccuguucaucgaggagggcaagaucgugcacaucagcccccugucgggcuccgcccagcacguggaggagugcagcugcuacccccgcuacccggggguccggugcgugugccgcgacaacuggaagggcuccaaccggcccaucguggacaucaacgucaaggacuacucgaucguguccagcuacgugugcuccggccucgucggggacacgccccgcaagaacgacucguccagcuccucguacugccggaaccccaacaacgagaagggcucccacggggugaagggcugggcguucgacgacgggaacgacgucuggaugggccgcaccaucagcgaggagcugcgguccggcuacgagaccuucaaggugaucgggggcuggucgaccccgaacuccaagcugcagaucaaccgccaggugaucgucgaccgggggaaccgcagcggcuacuccgggaucuucucgguggagggcaagagcugcaucaaccggugcuucuacguggagcucauccgcggccgcaagcaggagaacaaggucugguggaccuccaacucgaucgugguguucugcgggaccuccggcaccuacgggacgggcagcuggcccgacggggccgacaucaaccugaugcccaucuga

SEQ ID NO: 24449 - RNA, 1410 nt, Artificial Sequence
  derived and/or modified CDS sequence (AUadapt) from InfluenzaA__AFG99748__NA
augaaccccaaccagaagaucaucaccaucggcucggugucccugaccaucgccacgaucugcuuccucaugcagaucgccauccuggucaccaccgugacccugcacuucaagcaguacgacugcaacucgccgcccaacaaccaggcgaugcucugcgagcccacgaucaucgagcgcaacaucaccgagaucguguaccugaccaacaccacgaucgagaaggagaucugccccaagcuggccgaguaccggaacugguccaagccgcagugcaagaucaccggguucgcccccuucagcaaggacaacuccauccgccucucggccggcggggacaucugggucacccgggagcccuacguguccugcgaccccggcaagugcuaccaguucgcccuggggcagggcaccacgcugaacaaccgccacucgaacgacaccgugcacgaccggaccccguaccgcacccuccugaugaacgagcugggcguccccuuccaccucgggacgaagcaggucugcaucgcgugguccagcuccucgugccacgacggcaaggccuggcugcacgugugcgugaccgggcacgacgagaacgccaccgccuccuucaucuacgacggccggcugguggacucgaucggguccuggagcaagaacauccuccgcacccaggaguccgagugcgugugcaucaacggcacgugcaccgucgugaugaccgacggcucggcguccgagcgggccgacaccaagauccuguucaucgaggaggggaagaucgugcacaucucgccccugagcggcuccgcccagcacgucgaggagugcucgugcuacccccgcuacccgggggugcggugcgugugccgcgacaacuggaagggcuccaaccggcccaucgucgacaucaacgugaaggacuacucgaucguguccagcuacgucugcuccggccucgugggggacacgccccgcaagaacgacucguccucguccagcuacugccggaaccccaacaacgagaagggcucccacggggugaagggcugggccuucgacgacgggaacgacgucuggaugggccgcaccaucggcgaggagcugcggucgggguacgagaccuucaaggugaucggcgggugguccaccccgaacucgaagcugcagaucaaccgccaggucaucguggaccggggcaaccgcuccggguacagcggcaucuucuccguggagggcaagucgugcacgaaccggugcuucuacgucgagcucauccgcgggcgcaagcaggagaccgaggugugguggaccucgaacuccaucguggucuucugcggcaccagcgggacguacggcaccggguccuggcccgacggcgccgacaucaaccugaugcccaucuga

SEQ ID NO: 24450 - RNA, 1410 nt, Artificial Sequence; identical to SEQ ID NO: 24328
  derived and/or modified CDS sequence (AUadapt) from InfluenzaA__AFG99759__NA

SEQ ID NO: 24451 - RNA, 1410 nt, Artificial Sequence
  derived and/or modified CDS sequence (AUadapt) from InfluenzaA__AFG99770__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccagaucaugcucugcgagcccacgaucaucgagcgcaacaucaccgagaucguguaccugaccaacaccacgaucgagcgggagaucugccccaagcuggucgaguaccgcaacugguccaagccgcagugcaagaucaccggguucgcgcccuucagcaaggacaacuccauccggcucucggccggcggggacaucugggugacccgcgagcccuacguguccugcgaccccggcaagugcuaccaguucgcccuggggcagggcaccacgcugaacaaccggcacagcaacgacaccguccacgaccgcaccccguaccggacccuccugaugaacgagcugggcgugcccuuccaccucgggacgaagcaggucugcaucgccugguccucguccagcugccacgacggcaaggccuggcugcacgugugcgugaccgggcacgacgagaacgcgaccgccuccuucaucuacgacggccgccugguggacucgaucggguccuggagcaagaacauccuccggacccaggaguccgagugcgucugcaucaacggcacgugcaccguggugaugaccgacggcucggccuccgagcgcgccgacaccaagauccuguucaucgaggaggggaagaucguccacaucagcccccugucgggcuccgcgcagcacguggaggagugcucgugcuacccccgguacccgggggugcgcugcgucugccgggacaacuggaagggcuccaaccgccccaucguggacaucaacgugaaggacuacagcaucgucuccucguacgugugcuccggccucgugggggacacgccccggaagaacgacagcuccucguccagcuacugccgcaaccccaacaacgagaagggcucccacggggucaagggcugggccuucgacgacgggaacgacguguggaugggccggaccaucggcgaggagcugcgcucgggguacgagaccuucaaggucaucggcgggugguccaccccgaacagcaagcugcagaucaaccgccaggugaucguggaccggggcaaccgguccggguacucgggcaucuucuccgucgagggcaagagcugcaucaaccgcugcuucuacguggagcucauccgcgggcggaagcaggagacggaggugugguggaccucgaacuccaucgucguguucugcggcaccagcgggaccuacggcacgggguccuggcccgacggcgccgacaucaaccugaugcccaucuga

SEQ ID NO: 24452 - RNA, 1410 nt, Artificial Sequence
  derived and/or modified CDS sequence (AUadapt) from InfluenzaA__AFG99781__NA
augaaccccaaccagaagaucaucaccaucggcucggugucccugaccaucgccacgaucugcuuccucaugcagaucgccauccuggucaccaccgugacccugcacuucaagcaguacgagugcagcuccccgcccaacaaccaggugaugcucugccagcccacgaucaucgagcgcaacaucaccgagaucgucuaccugaccaacaccacgaucgagaaggagaucugccccaagcugguggaguaccggaacuggucgaagccgcagugcaagaucaccggguucgcgcccuucuccaaggacaacagcauccgccucuccgccggcggggacaucugggugacccgggagcccuacgucucgugcgaccccggcaagugcuaccaguucgcccuggggcagggcaccacgcugaacaaccgccacuccaacgacaccgugcacgaccggaccccguaccgcacccuccugaugaacgagcugggcgugcccuuccaccucgggacgaagcaggucugcaucgccuggagcuccucguccugccacgacggcaaggccuggcugcacgugugcgugaccgggcacgacgagaacgcgaccgccagcuucaucuacgacggccggcuggucgacuccaucgggucgugguccaagaacauccuccgcacccaggagagcgagugcgugugcaucaacggcacgugcaccguggucaugaccgacggcuccgccucgaagcgggccgacaccaagauccuguucaucgaggaggggaagaucgugcacaucagcccccuguccggcucggcgcagcacguggaggagugcuccugcuacccccgcuacccggggguccggugcgugugccgcgacaacuggaagggcagcaaccggcccaucguggacaucaacgucaaggacuacuccaucgugucguccuacgugugcagcggccucgucggggacacgccccgcaagaacgacuccucguccagcuccuacugccggaaccccaacaacgagaagggcucgcacggggugaagggcugggccuucgacgacgggaacgacgucuggaugggccgcaccaucuccgaggagcugcggagcggcuacgagaccuucaaggugaucgggggcugguccaccccgaacucgaagcugcagacgaaccgccaggugaucgucgacuccgggaaccggagcggcuacucggggaucuucuccguggagggcaagagcugcaucaaccgcugcuucuacguggagcucauccggggccgcaagcaggagaccaaggucugguggaccuccaacucgaucgugguguucugcgggaccuccggcacguacgggaccggcagcuggcccgacggggccgacaucaaccugaugcccaucuga

SEQ ID NO: 24453 - RNA, 1410 nt, Artificial Sequence; identical to SEQ ID NO: 24328
  derived and/or modified CDS sequence (AUadapt) from InfluenzaA__AFG99792__NA

SEQ ID NO: 24454 - RNA, 1410 nt, Artificial Sequence; identical to SEQ ID NO: 24448
  derived and/or modified CDS sequence (AUadapt) from InfluenzaA__AFG99803__NA

SEQ ID NO: 24455 - RNA, 1410 nt, Artificial Sequence; identical to SEQ ID NO: 24328
  derived and/or modified CDS sequence (AUadapt) from InfluenzaA__AFG99825__NA

SEQ ID NO: 24456 - RNA, 1410 nt, Artificial Sequence; identical to SEQ ID NO: 24328
  derived and/or modified CDS sequence (AUadapt) from InfluenzaA__AFG99836__NA

SEQ ID NO: 24457 - RNA, 1410 nt, Artificial Sequence; identical to SEQ ID NO: 24328
  derived and/or modified CDS sequence (AUadapt) from InfluenzaA__AFG99847__NA

SEQ ID NO: 24458 - RNA, 1410 nt, Artificial Sequence; identical to SEQ ID NO: 24328
  derived and/or modified CDS sequence (AUadapt) from InfluenzaA__AFG99858__NA

SEQ ID NO: 24459 - RNA, 1410 nt, Artificial Sequence; identical to SEQ ID NO: 24328
  derived and/or modified CDS sequence (AUadapt) from InfluenzaA__AFG99869__NA

SEQ ID NO: 24460 - RNA, 1410 nt, Artificial Sequence; identical to SEQ ID NO: 24328
  derived and/or modified CDS sequence (AUadapt) from InfluenzaA__AFG99880__NA

SEQ ID NO: 24461 - RNA, 1410 nt, Artificial Sequence
  derived and/or modified CDS sequence (AUadapt) from InfluenzaA__AFG99891__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuacuucaccaacaccacgaucgagaaggagaucugccccaagcuggcggaguaccggaacugguccaagccgcagugcaagaucaccggguucgcccccuucagcaaggacaacuccauccgccugucggccggcggggacaucugggugacccgggagcccuacguguccugcgaccccggcaagugcuaccaguucgcccucgggcagggcaccacgcugaacaaccgccacagcaacgacaccguccacgaccggaccccguaccgcacccugcucaugaacgagcugggcgugcccuuccaccuggggacgaagcaggucugcaucgccugguccucguccagcugccacgacggcaaggcguggcuccacgugugcgugaccgggcacgacgagaacgccaccgccuccuucaucuacgacggccggcugguggacucgaucggguccuggagcaagaacauccugcgcacccaggaguccgagugcgucugcaucaacggcacgugcaccguggugaugaccgacggcucggccuccgagcgggcggacaccaagauccucuucaucgaggaggggaagaucguccacaucagcucgcuguccggcagcgcccagcacguggaggagugcuccugcuacccccgcuaccccggggugcggugcgucugccgcgacaacuggaagggcucgaaccggccgaucguggacaucaacgugaaggacuacuccaucgucagcuccuacgugugcucgggccuggugggggacacgccccgcaagaacgacuccagcuccucguccuacugccggaaccccaacaacgagaagggcagccacggggucaagggcugggccuucgacgacgggaacgacguguggaugggccgcaccaucggcgaggagcuccgguccggguacgagaccuuccgcgucaucggcggguggucgacccccaacuccaagcugcagaucaaccgccaggugaucguggaccggggcaaccggagcggguacuccggcaucuucucggucgagggcaagagcugcaucaaccgcugcuucuacguggagcugauccgcgggcggaagcaggagacggaggugugguggaccuccaacucgaucgucguguucugcggcaccuccgggaccuacggcacggggagcuggccggacggcgccgacaucaaccucaugcccaucuga

SEQ ID NO: 24462 - RNA, 1410 nt, Artificial Sequence; identical to SEQ ID NO: 24328
  derived and/or modified CDS sequence (AUadapt) from InfluenzaA__AFG99902__NA

SEQ ID NO: 24463 - RNA, 1410 nt, Artificial Sequence; identical to SEQ ID NO: 24328
  derived and/or modified CDS sequence (AUadapt) from InfluenzaA__AFG99913__NA

SEQ ID NO: 24464 - RNA, 1410 nt, Artificial Sequence; identical to SEQ ID NO: 24328
  derived and/or modified CDS sequence (AUadapt) from InfluenzaA__AFG99924__NA

SEQ ID NO: 24465 - RNA, 1410 nt, Artificial Sequence
  derived and/or modified CDS sequence (AUadapt) from InfluenzaA__AFG99935__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucgucgagcgcaacaucaccgagaucguguaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacgucuccugcgaccccagcaagugcuaccaguucgcccugggccaggggaccacgcugaacaaccgccacuccaacgacaccgugcacgaccggaccccguaccgcacccuccugaugaacgagcugggcgugcccuuccaccucggcacgaagcaggucugcaucgccuggucguccagcuccugccacgacgggaaggcguggcugcacgugugcgugaccggccacgacgagaacgccaccgccucguucaucuacgacgggcggcuggucgacuccaucggcucgugguccaagaacauccuccgcacccaggagagcgagugcgugugcaucaacgggacgugcaccguggucaugaccgacggcuccgccucggagcgggcggacaccaagauccuguucaucgaggagggcaagaucgugcacaucagcccccuguccgggucggcccagcacguggaggagugcuccugcuacccccgcuacccgggcguccggugcgugugccgcgacaacuggaaggggagcaaccggcccaucguggacaucaacaugaaggacuacuccaucgucucguccuacgugugcagcggccucgugggcgacacgccccgcaacaacgacuccucguccucguccuacugccggaaccccaacaacgagaaggggagccacggcgucaaggggugggccuucgacgacggcaacgacguguggauggggcgcaccaucggcgaggagcugcgguccggcuacgagaccuucaaggucaucgggggcuggucgaccccgaacuccaagcugcagaucaaccgccaggugaucguggaccgggggaaccgcagcggcuacuccgggaucuucucggucgagggcaagagcugcaucaaccggugcuucuacguggagcucauccgcggccgcaagcaggagacggaggugugguggaccuccaacucgaucgucguguucugcgggaccuccggcaccuacgggacgggcagcuggcccgacggggccgacaucaaccugaugcccaucuga

SEQ ID NO: 24466 - RNA, 1410 nt, Artificial Sequence; identical to SEQ ID NO: 24328
  derived and/or modified CDS sequence (AUadapt) from InfluenzaA__AFG99946__NA

SEQ ID NO: 24467 - RNA, 1410 nt, Artificial Sequence
  derived and/or modified CDS sequence (AUadapt) from InfluenzaA__AFG99957__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggcgaugcucugcgagcccacgaucaucgagcgcaacaucaccgagaucguguaccugaccaacaccacgaucgagaaggagaucugccccaagcuggccgaguaccggaacugguccaagccgcagugcaagaucaccggguucgcccccuucagcaaggacaacuccauccgccucucggccggcggggacaucugggucacccgggagcccuacguguccugcgaccccggcaagugcuaccaguucgcccuggggcagggcaccacgcugaacaaccgccacucgaacgacaccgugcacgaccggaccccguaccgcacccuccugaugaacgagcugggcguccccuuccaccucgggacgaagcaggucugcaucgcgugguccagcuccucgugccacgacggcaaggccuggcugcacgugugcgugaccgggcacgacgagaacgccaccgccuccuucaucuacgacggccggcugguggacucgaucggguccuggagcaagaacauccuccgcacccaggaguccgagugcgugugcaucaacggcacgugcaccgucgugaugaccgacggcucggcguccgagcgggccgacaccaagauccuguucaucgaggaggggaagaucgugcacaucucgccccugagcggcuccgcccagcacgucgaggagugcucgugcuacccccgcuacccgggggugcggugcgugugccgcgacaacuggaagggcuccaaccggcccaucgucgacaucaacgugaaggacuacucgaucguguccagcuacgucugcuccggccucgugggggacacgccccgcaagaacgacucguccucguccagcuacugccggaaccccaacaacgagaagggcucccacggggugaagggcugggccuucgacgacgggaacgacgucuggaugggccgcaccaucggcgaggagcugcggucgggguacgagaccuucaaggugaucggcgggugguccaccccgaacucgaagcugcagaucaaccgccaggucaucguggaccggggcaaccgcuccggguacagcggcaucuucuccguggagggcaagucgugcacgaaccggugcuucuacgucgagcucauccgcgggcgcaagcaggagaccgaggugugguggaccucgaacuccaucguggucuucugcggcaccagcgggacguacggcaccggguccuggcccgacggcgccgacaucaaccugaugcccaucuga

SEQ ID NO: 24468 - RNA, 1410 nt, Artificial Sequence; identical to SEQ ID NO: 24328
  derived and/or modified CDS sequence (AUadapt) from InfluenzaA__AFG99968__NA

SEQ ID NO: 24469 - RNA, 1410 nt, Artificial Sequence
  derived and/or modified CDS sequence (AUadapt) from InfluenzaA__AFG99979__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcccugcgagcccacgaucaucgagcgcaacaucaccgagaucgucuaccucaccaacaccacgaucgagaaggagaucugcccgaagcugguggaguaccggaacugguccaagccccagugcaagaucaccggguucgcgcccuucagcaaggacaacuccauccgccugucggccggcggggacaucugggugacccgggagcccuacgucuccugcgacccgggcaagugcuaccaguucgcccucgggcagggcaccacgcugaacaaccgccacagcaacgacaccgugcacgaccggacccccuaccgcacccugcucaugaacgagcugggcgugcccuuccaccuggggacgaagcaggucugcaucgccugguccucguccagcugccacgacggcaaggccuggcuccacgugugcgugaccgggcacgacgagaacgcgaccgccuccuucaucuacgacggccggcuggucgacucgaucguguccuggagcaagaacauccugcgcacccaggaguccgagugcgugugcaucaacgggacgugcaccgucgugaugaccgacggcucggccuccgagcgggccgacaccaagauccucuucaucgaggagggcaagaucgugcacaucagcccccugucgggguccgcgcagcacgucgaggagugcagcugcuacccgcgcuaccccggcgugcggugcgugugccgcgacaacuggaagggguccaaccggcccaucgucgacaucaacgugaaggacuacucgaucguguccagcuacgucugcuccggccuggugggcgacacgccccgcaagaacgacucguccagcuccucguacugccucaacccgaacaacgagaaggggucccacggcgucaaggggugggccuucgacgacggcaacgacguguggauggggcggaccaucggcgaggagcugcgcagcggcuacgagaccuucaaggugaucgggggcugguccacccccaacucgaagcugcagacgaaccggcaggucaucguggaccgcgggaaccgguccggcuacagcgggaucuucuccguggagucgaagagcugcaucaaccgcugcuucuacgucgagcucauccggggccgcaagcaggagaccaaggugugguggaccuccaacucgaucguggucuucugcggcaccuccgggacguacggcaccgggagcuggcccgacggcgccgacaucaaccugaugcccaucuga

SEQ ID NO: 24470 - RNA, 1410 nt, Artificial Sequence
  derived and/or modified CDS sequence (AUadapt) from InfluenzaA__AFG99990__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggcgaugcucugcgagcccaagaucaucgagcgcaacaucacggagaucguguaccugaccaacaccaccaucgagaaggagaucugccccaagcuggccgaguaccggaacugguccaagccgcagugcaagaucacgggguucgcccccuucagcaaggacaacuccauccgccucucggccggcggggacaucugggucacccgggagcccuacguguccugcgaccccggcaagugcuaccaguucgcccuggggcagggcaccacccugaacaaccgccacagcaacgacacggugcacgaccggaccccguaccgcacccuccugaugaacgagcugggcguccccuuccaccucgggaccaagcaggucugcaucgcgugguccucguccucgugccacgacggcaaggccuggcugcacgugugcgugacggggcacgacgagaacgccaccgccuccuucaucuacgacggccggcugguggacagcaucggguccuggucgaagaacauccuccgcacccaggaguccgagugcgugugcaucaacgggaccugcacggucgugaugaccgacggcagcgcguccgagcgggccgacaccaagauccuguucaucgaggagggcaagaucgugcacaucucgccccugucgggcuccgcccagcacgucgaggagugcagcugcuacccccgcuacccgggggugcggugcgugugccgcgacaacuggaagggcuccaaccggcccaucgucgacaucaacgugaaggacuacucgaucguguccagcuacgucugcuccggccucgugggggacacgccccgcaagaacgacucguccucguccagcuacugccggaaccccaacaacgagaagggcucccacggggugaagggcugggccuucgacgacgggaacgacgucuggaugggccgcaccaucucggaggagcugcgguccggcuacgagaccuucaaggugaucgggggcuggagcaagccgaacuccaagcugcagaucaaccgccaggucaucguggaccgggggaaccgcucgggcuacuccgggaucuucucgguggagggcaagagcugcaucaaccggugcuucuacgucgagcucauccgcggccgcaagcaggagaccgaggugugguggaccuccaacucgaucguggucuucugcgggacguccggcaccuacgggaccggcagcuggcccgacggggccgacaucaaccugaugcccaucuga

SEQ ID NO: 24471 - RNA, 1410 nt, Artificial Sequence
  derived and/or modified CDS sequence (AUadapt) from InfluenzaA__AFH00002__NA
augaaccccaaccagaagaucaucaccaucggcucggugucccugaccaucgccacgaucugcuuccucaugcagaucgccauccuggucaccaccgugacccugcacuucaagcaguacgagugcagcuccccgcccaacaaccaggugauccccugccagcccacgaucaucgagcgcaacaucaccgagaucgucuaccucaccaacaccacgaucgagaaggagaucugcccgaagcugguggaguaccggaacuggucgaagccccagugcaagaucaccggguucgcgcccuucuccaaggacaacagcauccgccuguccgccggcggggacaucugggugacccgggagcccuacgucucgugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggagcuccucguccugccacgacggcaaggccuggcuccacgugugcgugaccgggcacgacgagaacgcgaccgccagcuucaucuacgacggccggcuggucgacuccaucgggucgugguccaagaacauccugcgcacccaggagagcgagugcgugugcaucaacggcacgugcgccguggucaugaccgacggcuccgccucggagcgggcggacaccaagauccucuucaucgaggaggggaagguggugcacaucagcccccuguccggcucggcccagcacgucgaggagugcuccugcuacccgcgcuaccccggggugcggugcgugugccgcgacaacuggaagggcagcaaccggcccaucgucgacaucaacgugaagaacuacuccaucgugucguccuacgucugcagcggccuggugggggacacgccccgcaagaacgacuccucguccagcuccuacugccggaacccgaacaacgagaagggcucgcacggggucaagggcugggccuucgacgacgggaacgacguguggaugggccgcaccaucuccgaggagcuccggagcggcuacgagaccuucaaggugaucgggggcugguccacccccaacucgaagcugcagaucaaccgccaggucaucguggacuccgggaaccggagcggcuacucggggaucuucuccguggagggcaagagcugcaucaaccgcugcuucuacgucgagcugauccggggccgcaagcaggagaccaaggugugguggacguccaacucgaucguggucuucugcgggaccuccggcaccuacgggaccggcagcuggcccgacggggccgacaucaaccucaugcccaucuga

SEQ ID NO: 24472 - RNA, 1410 nt, Artificial Sequence; identical to SEQ ID NO: 17587
  derived and/or modified CDS sequence (AUadapt) from InfluenzaA__AFH00013__NA

SEQ ID NO: 24473 - RNA, 1410 nt, Artificial Sequence
  derived and/or modified CDS sequence (AUadapt) from InfluenzaA__AFH00024__NA
augaaccccaaccagaagaucaucaccaucggcucggugucccugaccaucgccacgaucugcuuccucaugcagaucaccauccuggucaccaccgugacgcugcacuucaagcaguacgagugcaacucgccgcccaacaaccaggugaugcucugcgagcccaccaucaucgagcgcaacaucaccgagaucgucuaccugaccaacacgaccaucgagaaggagaucugccccaagcugguggaguaccggaacugguccaagccgcagugcaagaucaccggguucgcccccuucagcaaggacaacuccauccgccucucggcgggcggggacaucugggugacccgggagcccuacgucuccugcgaccccggcaagugcuaccaguucgcccuggggcagggcacgacccugaacaaccgccacagcaacgacaccgugcacgaccggaccccguaccgcacgcuccugaugaacgagcugggcgugcccuuccaccucgggaccaagcaggucugcaucgccugguccucguccagcugccacgacggcaaggccuggcugcacgugugcgugaccgggcacgacgagaacgccaccgcguccuucaucuacgacggccggcuggucgacucgaucggguccuggagcaagaacauccuccgcacgcaggaguccgagugcgugugcaucaacgggaccugcaccguggucaugaccgacggcucggccuccgagcgggccgacacgaagauccuguucaucgaggagggccgcaucgugcacaucagcccccugucgggcuccgcccagcacguggaggagugcagcugcuacccccgguacccggggguccgcugcgugugccgggacaacuggaagggcuccaaccgccccaucguggacaucaacgucaaggacuacucgaucguguccagcuacgugugcuccggccucgucggggacacgccccggaagaacgacucguccagcuccucguacugccgcaaccccaacaacgagaagggcucccacggggugaagggcugggcguucgacgacgggaacgacgucuggaugggccggaccaucagcgaggagcugcgcuccggcuacgagaccuucaaggugaucgggggcuggucgaccccgaacuccaagcugcagaucaaccgccaggugaucgucgaccgggggaaccggagcggcuacuccgggaucuucucgguggagggcaagagcugcaucaaccgcugcuucuacguggagcucauccgcggccggaagcaggagaacaaggucugguggaccuccaacucgaucgugguguucugcgggaccuccggcaccuacgggacgggcagcuggcccgacggggccgacaucaaccugaugcccaucuga

SEQ ID NO: 24474 - RNA, 1410 nt, Artificial Sequence; identical to SEQ ID NO: 17587
  derived and/or modified CDS sequence (AUadapt) from InfluenzaA__AFH00035__NA

SEQ ID NO: 24475 - RNA, 1410 nt, Artificial Sequence; identical to SEQ ID NO: 17587
  derived and/or modified CDS sequence (AUadapt) from InfluenzaA__AFH00046__NA

SEQ ID NO: 24476 - RNA, 1410 nt, Artificial Sequence
  derived and/or modified CDS sequence (AUadapt) from InfluenzaA__AFH00057__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggucgaagaacguccuccgcacccaggaguccgagugcgugugcaucaacggcacgugcaccguggucaugaccgacggcagcgccuccgagcgggcggacaccaagauccuguucaucgaggaggggaagaucgugcacaucucgccccugagcggcuccgcccagcacguggaggagugcucgugcuacccccgcuacccggggguccggugcgugugccgcgacaacuggaagggcuccaaccggcccaucguggacaucaacgucaaggacuacagcaucguguccucguacgugugcuccggccucgucggggacacgccccgcaagaacgacagcuccucguccucguacugccggaaccccaacaacgagaagggcucccacggggugaagggcugggccuucgacgacgggaacgacgucuggaugggccgcaccaucagcgaggagcugcgguccggcuacgagaccuucaaggugaucgggggcuggucgaacccgaacuccaagcugcagaucaaccgccaggugaucgucgaccgggggaaccgcagcggcuacuccgggaucuucucgguggagggcaagagcugcaucaaccggugcuucuacguggagcucauccgcggccgcaagcaggagaccgaggucugguggacguccaacucgaucgugguguucugcgggaccuccggcaccuacgggaccggcagcuggcccgacggggccgacaucaaccugaugcccaucuga

SEQ ID NO: 24477 - RNA, 1410 nt, Artificial Sequence; identical to SEQ ID NO: 17587
  derived and/or modified CDS sequence (AUadapt) from InfluenzaA__AFH00068__NA

SEQ ID NO: 24478 - RNA, 1410 nt, Artificial Sequence
  derived and/or modified CDS sequence (AUadapt) from InfluenzaA__AFH00079__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggucgaagaacauccuccgcacccaggaguccgagugcgucugcaucaacggcacgugcaccguggugaugaccgacggcagcgccuccgagcgggcggacaccaagauccuguucaucgaggaggggaagaucguccacaucucgccccugagcggcuccgcccagcacguggaggagugcucgugcuacccccgcuacccgggggugcggugcgucugccgcgacaacuggaagggcuccaaccggcccaucguggacaucaacgugaaggacuacagcaucgucuccucguacgugugcuccggccucgugggggacacgccccgcaagaacgacagcuccucguccucguacugccggaaccccaacaacgagaagggcucccacggggucaagggcugggccuucgacgacgggaacgacguguggaugggccgcaccaucagcgaggagcugcgguccggcuacgagaccuucaaggucaucgagggguggucgaagccgaacuccaagcugcagaucaaccgccaggugaucguggaccggggcaaccgcagcggguacuccggcaucuucucggucgagggcaagagcugcaucaaccggugcuucuacguggagcucauccgcgggcgcaagcaggagaccgaggugugguggacguccaacucgaucgucguguucugcggcaccuccgggaccuacggcaccgggagcuggcccgacggcgccgacaucaaccugaugcccaucuga

SEQ ID NO: 24479 - RNA, 1410 nt, Artificial Sequence
  derived and/or modified CDS sequence (AUadapt) from InfluenzaA__AFH00090__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggagcaagaacauccuccgcacccaggaguccgagugcgucugcaucaacggcacgugcaccguggugaugaccgacggcucggccuccgagcgggcggacaccaagauccuguucaucgaggaggggaagaucguccacaucagcccccugucgggcuccgcccagcacguggaggagugcagcugcuacccccgcuacccgggggugcggugcgucugccgcgacaacuggaagggcuccaaccggcccaucguggacaucaacgugaaggacuacucgaucgucuccagcuacgugugcuccggccucgugggggacacgccccgcaagaacgacucguccagcuccucguacugcuggaaccccaacaacgagaagggcucccacggggucaagggcugggccuucgacgacgggaacgacguguggaugggccggaccaucagcgaggagcugcgcuccggcuacgagaccuucaaggucaucgggggcuggucgaagccgaacuccaagcugcagaucaaccgccaggugaucguggaccgggggaaccggagcggcuacuccgggaucuucucggucgagggcaagagcugcaucaaccgcugcuucuacguggagcucauccggggccgcaagcaggagaccgaggugugguggacguccaacucgaucgucguguucugcgggaccuccggcaccuacgggaccggcagcuggcccgacggggccgacaucaaccugaugcccaucuga

SEQ ID NO: 24480 - RNA, 1410 nt, Artificial Sequence
  derived and/or modified CDS sequence (AUadapt) from InfluenzaA__AFH00101__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggucgaagaagauccuccgcacccaggaguccgagugcgucugcaucaacggcacgugcaccguggugaugaccgacggcagcgccuccgagcgggcggacaccaagauccuguucaucgaggaggggaagaucguccacaucucgccccugagcggcuccgcccagcacguggaggagugcucgugcuacccccgcuacccgggggugcggugcgucugccgcgacaacuggaagggcuccaaccggcccaucguggacaucaacgugaaggacuacagcaucgucuccucguacgugugcuccggccucgugggggacacgccccgcaagaacgacagcuccucguccucguacugccggaaccccaacaacgagaagggcucccacggggucaagggcugggccuucgacgacgggaacgacguguggaugggccgcaccaucagcgaggagcugcgguccggcuacgagaccuucaaggucaucgggggcuggucgaagccgaacuccaagcugcagaucaaccgccaggugaucguggaccgggggaaccgcagcggcuacuccgggaucuucucggucgagggcaagagcugcaucaaccggugcuucuacguggagcucauccgcggccgcaagcaggagaccgaggugugguggacguccaacucgaucgucguguucugcgggaccuccggcaccuacgggaccggcagcuggcccgacggggccgacaucaaccugaugcccaucuga

SEQ ID NO: 24481 - RNA, 1410 nt, Artificial Sequence; identical to SEQ ID NO: 17503
  derived and/or modified CDS sequence (AUadapt) from InfluenzaA__AFH00112__NA

SEQ ID NO: 24482 - RNA, 1410 nt, Artificial Sequence; identical to SEQ ID NO: 17503
  derived and/or modified CDS sequence (AUadapt) from InfluenzaA__AFH00123__NA

SEQ ID NO: 24483 - RNA, 1410 nt, Artificial Sequence
  derived and/or modified CDS sequence (AUadapt) from InfluenzaA__AFH00156__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggucgaagaacauccuccgcacccaggaguccgagugcgucugcaucaacggcacgugcaccguggugaugaccgacggcagcgccuccgagcgggcggacaccaagauccuguucaucgaggaggggaagaucguccacaucucgccccugagcggcuccgcccagcacguggaggagugcucgugcuacccccgcuacccgggggugcggugcgucugccgcgacaacuggaagggcuccaaccggcccaucaucgacaucaacgugaaggacuacagcaucguguccucguacgucugcuccggccucgugggggacacgccccgcaagaacgacagcuccucguccucguacugccggaaccccaacaacgagaagggcucccacggggugaagggcugggccuucgacgacgggaacgacgucuggaugggccgcaccaucagcgaggagcugcgguccggcuacgagaccuucaaggugaucgggggcuggucgaagccgaacuccaagcugcagaucaaccgccaggucaucguggaccgggggaaccgcagcggcuacuccgggaucuucucgguggagggcaagagcugcaucaaccggugcuucuacgucgagcucauccgcggccgcaagcaggagaccgaggugugguggacguccaacucgaucguggucuucugcgggaccuccggcaccuacgggaccggcagcuggcccgacggggccgacaucaaccugaugcccaucuga

SEQ ID NO: 24484 - RNA, 1410 nt, Artificial Sequence
  derived and/or modified CDS sequence (AUadapt) from InfluenzaA__AFH00167__NA
augaaccccaaccagaagaucaucaccaucggcucggugucccugaccaucgccacgaugugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggucgaagaacauccuccgcacccaggaguccgagugcgucugcaucaacggcacgugcaccguggugaugaccgacggcagcgccuccgagcgggcggacaccaagauccuguucaucgaggaggggaagaucguccacaucucgccccugagcggcuccgcccagcacguggaggagugcucgugcuacccccgcuacccgggggugcggugcgucugccgcgacaacuggaagggcuccaaccggcccaucguggacaucaacgugaaggacuacagcaucgucuccucguacgugugcuccggccucgugggggacacgccccgcaagaacgacagcuccucguccucguacugccggaaccccaacaacgagaagggcucccacggggucaagggcugggccuucgacgacgggaacgacguguggaugggccgcaccaucagcgaggagcugcgguccggcuacgagaccuucaaggucaucgggggcuggucgaagccgaacuccaagcugcagaucaaccgccaggugaucguggaccgggggaaccgcagcggcuacuccgggaucuucucggucgagggcaagagcugcaucaaccggugcuucuacguggagcucauccgcggccgcaagcaggagaccgaggugugguggacguccaacucgaucgucguguucugcgggaccuccggcaccuacgggaccggcagcuggcccgacggggccgacaucaaccugaugcccaucuga

SEQ ID NO: 24485 - RNA, 1410 nt, Artificial Sequence; identical to SEQ ID NO: 24483
  derived and/or modified CDS sequence (AUadapt) from InfluenzaA__AFH00178__NA

SEQ ID NO: 24486 - RNA, 1410 nt, Artificial Sequence
  derived and/or modified CDS sequence (AUadapt) from InfluenzaA__AFH00189__NA
augaaccccaaccagaagaucaucaccaucggcucggugucccugaccaucgccacgaucugcuuccucaugcagaucgccauccuggucaccaccgugacccugcacuucaagcaguacgaguacaacucgccgcccaacaaccaggugaugcucugcgagcccaagaucaucgagcgcaacaucacggagaucgucuaccugaccaacaccaccaucgagaaggagaucugccccaagcuggcggaguaccggaacugguccaagccgcagugcaagaucacgggguucgcccccuucagcaaggacaacuccauccgccucucggccggcggggacaucugggugacccgggagcccuacguguccugcgaccccggcaagugcuaccaguucgcccuggggcagggcaccacccugaacaaccgccacagcaacgacacgguccacgaccggaccccguaccgcacccuccugaugaacgagcugggcgugcccuuccaccucgggaccaagcaggucugcaucgccugguccucguccagcugccacgacggcaaggcguggcugcacgugugcgugacggggcacgacgagaacgccaccgccuccuucaucuacgacggccggcugguggacucgaucggguccuggucgaagaacauccuccgcacccaggaguccgagugcgucugcaucaacgggaccugcacgguggugaugaccgacggcagcgccuccgagcgggcggacaccaagauccuguucaucgaggagggcaagaucguccacaucucgccccugagcggcuccgcccagcacguggaggagugcucgugcuacccccgcuacccgggggugcggugcgucugccgcgacaacuggaagggcuccaaccggcccaucguggacaucaacgugaaggacuacagcaucgucuccucguacgugugcuccggccucgugggggacacgccccgcaagaacgacagcuccucguccucguacugccggaaccccaacaacgagaagggcucccacggggucaagggcugggccuucgacgacgggaacgacguguggaugggccgcaccaucagcgaggagcugcgguccggcuacgagaccuucaaggucaucgggggcuggucgaagccgaacuccaagcugcagaucaaccgccaggugaucguggaccgggggaaccgcagcggcuacuccgggaucuucucggucgagggcaagagcugcaucaaccggugcuucuacguggagcucauccgcggccgcaagcaggagaccgaggugugguggaccuccaacucgaucgucguguucugcgggacguccggcaccuacgggaccggcagcuggcccgacggggccgacaucaaccugaugcccaucuga

SEQ ID NO: 24487 - RNA, 1410 nt, Artificial Sequence; identical to SEQ ID NO: 17587
  derived and/or modified CDS sequence (AUadapt) from InfluenzaA__AFH00200__NA

SEQ ID NO: 24488 - RNA, 1410 nt, Artificial Sequence; identical to SEQ ID NO: 24484
  derived and/or modified CDS sequence (AUadapt) from InfluenzaA__AFH00211__NA

SEQ ID NO: 24489 - RNA, 1410 nt, Artificial Sequence
  derived and/or modified CDS sequence (AUadapt) from InfluenzaA__AFH00222__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacaacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggucgaagaacauccuccgcacccaggaguccgagugcgucugcaucaacggcacgugcaccguggugaugaccgacggcagcgccuccgagcgggcggacaccaagauccuguucaucgaggaggggaagaucguccacaucucgccccugagcggcuccgcccagcacguggaggagugcucgugcuacccccgcuacccgggggugcggugcgucugccgcgacaacuggaagggcuccaaccggcccaucguggacaucaacgugaaggacuacagcaucgucuccucguacgugugcuccggccucgugggggacacgccccgcaagaacgacagcuccucguccucguacugccggaaccccaacaacgagaagggcucccacggggucaagggcugggccuucgacgacgggaacgacguguggaugggccgcaccaucagcgaggagcugcgguccggcuacgagaccuucaaggucaucgggggcuggucgaagccgaacuccaagcugcagaucaaccgccaggugaucguggaccgggggaaccgcagcggcuacuccgggaucuucucggucgagggcaagagcugcaucaaccggugcuucuacguggagcucauccgcggccgcaagcaggagaccgaggugugguggacguccaacucgaucgucguguucugcgggaccuccggcaccuacgggaccggcagcuggcccgacggggccgacaucaaccugaugcccaucuga

SEQ ID NO: 24490 - RNA, 1410 nt, Artificial Sequence; identical to SEQ ID NO: 17503
  derived and/or modified CDS sequence (AUadapt) from InfluenzaA__AFH00233__NA

SEQ ID NO: 24491 - RNA, 1410 nt, Artificial Sequence
  derived and/or modified CDS sequence (AUadapt) from InfluenzaA__AFH00244__NA
augaaccccaaccagaagaucaucaccaucggcucggugucccugaccaucgccacgaucugcuuccucaugcagaucgccauccuggucaccaccgugacccuguacuucaagcaguacgagugcaacagcccgcccuccaaccaggugaugcucugcgagcccacgaucgucgagcgcaacaucaccgagaucguguaccugaccaacaccacgaucgagaaggagaucugccccaagcuggcggaguaccggaacuggucgaagccgcagugcaagaucaccggguucgcccccuucuccaaggacaacagcauccgccucuccgccggcggggacaucugggugacccgggagcccuacgucucgugcgaccccggcaagugcuaccaguucgcccuggggcagggcaccacgcugaacaaccgccacuccaacgacaccgugcacgaccggaccccguaccgcacccuccugaugaacgagcugggcgugcccuuccaccucgggacgaagcaggucugcaucgccuggagcuccucguccugccacgacggcaaggcguggcugcacgugugcgugaccgggcacgacgagaacgccaccgccagcuucaucuacgacggccggcuggucgacuccaucgggucgugguccaagaacauccuccgcacccaggagagcgagugcgugugcaucaacggcacgugcaccguggucaugaccgacggcuccgccucggagcgggcggacaccaagauccuguucaucgaggaggggaagaucgugcacaucagcccccuguccggcucggccaagcacguggaggagugcuccugcuacccccgcuacccggggguccggugcgugugccgcgacaacuggaagggcagcaaccggcccaucguggacaucaacgucaaggacuacuccaucgugucguccuacgugugcagcggccucgucggggacacgccccgcaagaacgacuccucguccagcuccuacugccggaaccccaacaacgagaagggcucgcacggggugaagggcugggccuucgacgacgggaacgacgucuggaugggccgcaccaucuccgaggagcugcggagcggcuacgagaccuucaaggugaucgggggcugguccaagccgaacucgaagcugcagaucaaccgccaggugaucgucgaccgggggaaccgcuccggcuacagcgggaucuucucgguggagggcaaguccugcaucaaccggugcuucuacguggagcucauccgcggccgcaagcaggagaccgaggucugguggacgagcaacuccaucgugguguucugcgggaccagcggcaccuacgggaccggcuccuggcccgacggggccgacaucaaccugaugcccaucuga

SEQ ID NO: 24492 - RNA, 1410 nt, Artificial Sequence; identical to SEQ ID NO: 17587
  derived and/or modified CDS sequence (AUadapt) from InfluenzaA__AFH00255__NA

SEQ ID NO: 24493 - RNA, 1410 nt, Artificial Sequence; identical to SEQ ID NO: 17587
  derived and/or modified CDS sequence (AUadapt) from InfluenzaA__AFH00266__NA

SEQ ID NO: 24494 - RNA, 1410 nt, Artificial Sequence
  derived and/or modified CDS sequence (AUadapt) from InfluenzaA__AFH00277__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccuccaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacucgauccgccucuccgccggcggggacaucugggugacccgggagcccuacgugagcugcgaccccggcaagugcuaccaguucgcccuggggcagggcaccacgcugaacaaccgccacuccaacgacaccguccacgaccggaccccguaccgcacccuccugaugaacgagcugggcgugcccuuccaccucgggacgaagcaggucugcaucgccuggucguccagcuccugccacgacggcaaggcguggcugcacgugugcgugaccgggcacgacgagaacgccaccgccucguucaucuacgacggccggcugguggacuccaucgggagcugguccaagaacauccuccgcacccaggagucggagugcgucugcaucaacggcacgugcaccguggugaugaccgacggcuccgccagcgagcgggcggacaccaagauccuguucaucgaggaggggaagaucguccacaucucgccccuguccggcagcgcccagcacguggaggagugcuccugcuacccccgcuacccgggggugcggugcgucugccgcgacaacuggaagggcucgaaccggcccaucguggacaucaacgugaaggacuacuccaucgucagcuccuacgugugcucgggccucgugggggacacgccccgcaagaacgacuccagcuccucguccuacugccggaagcccaacaacgagaagggcagccacgggcugaagggcugggccuucgacgacgggaacgacgucuggaugggccgcaccaucuccgaggagcugcggucgggcuacgagaccuucaaggugaucgggggcugguccaagccgaacagcaagcuccagaucaaccgccaggucaucguggaccgggggaaccgcuccggcuacucggggaucuucagcguggagggcaaguccugcaucaaccggugcuucuacgucgagcugauccgcggccgcaagcaggagaccgaggugugguggacgucgaacuccaucguggucuucugcgggaccagcggcaccuacgggaccggcuccuggcccgacggggccgacaucaaccugaugcccaucuga

SEQ ID NO: 24495 - RNA, 1410 nt, Artificial Sequence; identical to SEQ ID NO: 17587
  derived and/or modified CDS sequence (AUadapt) from InfluenzaA__AFH00288__NA

SEQ ID NO: 24496 - RNA, 1410 nt, Artificial Sequence; identical to SEQ ID NO: 24419
  derived and/or modified CDS sequence (AUadapt) from InfluenzaA__AFH00299__NA

SEQ ID NO: 24497 - RNA, 1410 nt, Artificial Sequence
  derived and/or modified CDS sequence (AUadapt) from InfluenzaA__AFH00310__NA
augaaccccaaccagaagaucaucaccaucggcucggugucccugaccaucgccacgaucugcuuccucaugcagaucgccauccuggucaccaccgugacccugcacuucaagcaguacgagugcagcuccucgccgaacaaccaggugauccccugccagcccacgaucaucgagcgcaacaucaccgagaucgucuaccucaccaacaccacgaucgagaaggagaucugccccaagcugguggaguaccggaacugguccaagccgcagugcaagaucaccggguucgcgcccuucagcaaggacaacuccauccgccugucggccggcggggacaucugggugacccgggagcccuacgucuccugcgaccccggcaagugcuaccaguucgcccucgggcagggcaccacgcugaacaaccgccacagcaacgacaccgugcacgaccggaccccguaccgcacccugcucaugaacgagcugggcgugcccuuccaccuggggacgaagcaggucugcaucgccugguccucguccagcugccacgacggcaaggccuggcuccacgugugcgugaccgggcacgacgagaacgcgaccgccuccuucaucuacgacggccggcuggucgacucgaucggguccuggagcaagaacauccugcgcacccaggaguccgagugcgugugcaucaacggcacgugcaccguggucaugaccgacggcucggccagcgagaaggccgacaccaagauccucuucaucgaggaggggaagguggugcacaucagcccccuguccggcuccgcgcagcacgucgaggagugcucgugcuacccccgguacccgggggugcgcugcgugugccgggacaacuggaagggcuccaaccgccccaucgucgacaucaacgugaagaacuacagcaucguguccucguacgucugcuccggccuggugggggacacgccccggaagaacgacagcuccucguccagcuacugccgcaaccccaacaacgagaagggcucccacggggucaagggcugggccuucgacgacgggaacgacguguggaugggccggaccaucucggaggagcuccgcuccggcuacgagaccuucaaggugaucgggggcuggagcaccccgaacuccaagcugcagaucaaccggcaggucaucguggacucggggaaccgcagcggcuacuccgggaucuucucgguggagggcaaguccugcaucaaccggugcuucuacgucgagcugauccgcggccggaagcaggagacgaaggugugguggaccagcaacucccucguggucuucugcgggaccagcggcaccuacgggacgggcuccuggcccgacggggccgacaucaaccugaugcccaucuga

SEQ ID NO: 24498 - RNA, 1410 nt, Artificial Sequence; identical to SEQ ID NO: 24497
  derived and/or modified CDS sequence (AUadapt) from InfluenzaA__AFH00321__NA

SEQ ID NO: 24499 - RNA, 1410 nt, Artificial Sequence
  derived and/or modified CDS sequence (AUadapt) from InfluenzaA__AFH00332__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacucgaacgacaccguccacgaccggaccccguaccgcacccuccugaugaacgagcugggcgugcccuuccaccucgggacgaagcaggucugcaucgccugguccagcuccucgugccacgacggcaaggcguggcugcacgugugcgugaccgggcacgacgagaacgccaccgccuccuucaucuacgacggccggcugguggacagcaucggguccuggucgaagaacauccuccgcacccaggaguccgagugcgucugcaucaacggcacgugcaccguggugaugaccgacggcucggccuccgagcgggcggacaccaagauccuguucaucgaggaggggaagaucguccacaucagcccccugucgggcuccgcccagcacguggaggagugcucgugcuacccccgcuacccgggggugcggugcgucugccgcgacaacuggaagggcuccaaccggcccaucguggacaucaacgugaaggacuacagcaucgucuccucguacgugugcuccggccucgugggggacacgccccgcaagaacgacagcuccucguccucgcacugccugaaccccaacaacgaggagggcgggcacggcgucaaggggugggccuucgacgacggcaacgacguguggaugggccggaccaucuccgagaagcugcgcagcggguacgagaccuucaaggucaucggcgggugguccaagccgaacucgaagcuccagaucaaccgccaggugaucguggaccggggcaaccgguccggguacucgggcaucuucuccgucgagggcaaggggugcaucaaccgcugcuucuacguggagcugauccggggccgcaagcaggagaccgaggugugguggacgagcaacucgaucgucguguucugcgggaccuccggcaccuacgggaccggcagcuggcccgacggcgccgacaucaaccugaugcccaucuga

SEQ ID NO: 24500 - RNA, 1410 nt, Artificial Sequence
  derived and/or modified CDS sequence (AUadapt) from InfluenzaA__AFH00343__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccuccaaccaggcgaugcucugcgagcccacgaucaucgagcgcaacaucaccgagaucguguaccugaccaacaccacgaucgagaaggagaucugccccaagcuggccgaguaccggaacuggagcaagccgcagugcaagaucaccggguucgcccccuucuccaaggacaacucgauccgccucuccgccggcggggacaucugggucacccgggagcccuacgugagcugcgaccccggcaagugcuaccaguucgcccuggggcagggcaccacgcugaacaaccgccacuccaacgacaccgugcacgaccggaccccguaccgcacccuccugaugaacgagcugggcguccccuuccaccucgggacgaagcaggucugcaucgcguggucguccagcuccugccacgacggcaaggccuggcugcacgugugcgugaccgggcacgacgagaacgccaccgccucguucaucuacgacggccggcugguggacuccaucgggucgugguccaagaacauccuccgcacccaggagagcgagugcgugugcaucaacggcacgugcaccgucgugaugaccgacggcuccgcgucggagcgggccgacaccaagauccuguucaucgaggaggggaagaucgugcacaucagcccccuguccggcucggcccagcacgucgaggagugcuccugcuacccccgcuacccgggggugcggugcgugugccgcgacaacuggaagggcagcaaccggcccaucgucgacaucaacgugaaggacuacuccaucgugucguccuacgucugcagcggccucgugggggacacgccccgcaagaacgacuccucguccucguccuacugccggaaccccaacaacgagaagggcagccacggggugaagggcugggccuucgacgacgggaacgacgucuggaugggccgcaccaucuccgaggagcugcggucgggcuacgagaccuucaaggugaucgggggcugguccaagccgaacagcaagcugcagaucaaccgccaggucaucguggaccgggggaaccgcuccggcuacucggggaucuucagcguggagggcaaguccugcaucaaccggugcuucuacgucgagcucauccgcggccgcaagcaggagaccgaggugugguggacgucgaacuccaucguggucuucugcgggaccagcggcaccuacgggaccggcuccuggcccgacggggccgacaucaaccugaugcccaucuga

SEQ ID NO: 24501 - RNA, 1410 nt, Artificial Sequence
  derived and/or modified CDS sequence (AUadapt) from InfluenzaA__AFH00354__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccaagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggagcaagaacauccuccgcacccaggaguccgagugcgucugcaucaacggcacgugcaccguggugaugaccgacggcucggccuccgagcgggcggacaccaagauccuguucaucgaggaggggaagaucguccacaucagcccccugucgggcuccgcccagcacguggaggagugcucgugcuacccccgcuacccgggggugcggugcgucugccgcgacaacuggaagggcuccaaccggcccaucguggacaucaacgugaaggacuacagcaucgucuccucguacgugugcuccggccucgugggggacacgccccgcaagaacgacagcuccucguccagcuacugccugaaccccaacaacgaggagggcgggcacggcgucaaggggugggccuucgacgacggcaacgacguguggaugggccggaccaucuccgagaagcugcgcucgggguacgagaccuucaaggucaucggcgggugguccaagccgaacagcaagcuccagaucaaccgccaggugaucguggaccggggcaaccgguccggguacucgggcaucuucuccgucgagggcaagagcugcgugaaccgcugcuucuacguggagcugauccgggggcgcaagcaggagaccgaggucugguggacgucgaacuccaucgugguguucugcggcaccagcgggaccuacggcaccggguccuggcccgacggcgccgacaucaaccugaugcccaucuga

SEQ ID NO: 24502 - RNA, 1410 nt, Artificial Sequence; identical to SEQ ID NO: 17382
  derived and/or modified CDS sequence (AUadapt) from InfluenzaA__AFH00365__NA

SEQ ID NO: 24503 - RNA, 1410 nt, Artificial Sequence
  derived and/or modified CDS sequence (AUadapt) from InfluenzaA__AFH00376__NA
augaaccccaaccagaagaucaucaccaucggcucggugucccugaccaucgccacgaucugcuuccucaugcagaucgccauccuggucaccaccgugacccugcacuucaagcagugcgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggagcaagaacauccuccgcacccaggaguccgagugcgucugcaucaacggcacgugcaccguggugaugaccgacggcucggccuccgggcgggcggacaccaagauccuguucaucgaggagggcaagaucguccacaucagcccccugucgggguccgcccagcacguggaggagugcucgugcuacccccgcuacccgggcgugcggugcgucugccgcgacaacuggaagggcuccaaccggcccaucguggacaucaacgugaaggacuacagcaucgucuccucguacgugugcuccgggcucgugggcgacacgccccgcaagaacgacagcuccucguccagcuacugccugaaccccaacaacgaggagggcgggcacggggucaagggcugggccuucgacgacggcaacgacguguggauggggcggaccaucuccgagaagcugcgcucgggcuacgagaccuucaaggucaucgggggcugguccaagccgaacagcaagcuccagaucaaccgccaggugaucguggaccgggggaaccgguccggcuacucgggcaucuucuccgucgagggcaagagcugcaucaaccgcugcuucuacguggagcugauccgggggcgcaagcaggagaccgaggugugguggacgucgaacuccaucgucguguucugcgggaccagcggcaccuacgggaccggcuccuggcccgacggcgccgacaucaaccugaugcccaucuga

SEQ ID NO: 24504 - RNA, 1410 nt, Artificial Sequence
  derived and/or modified CDS sequence (AUadapt) from InfluenzaA__AFH00387__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccucguccagcugccacgacgggaaggcguggcugcacgugugcgugaccggccacgacgagaacgccaccgccuccuucaucuacgacgggcggcugguggacucgaucuccagcugguccaagaacauccuccgcacccaggagucggagugcgucugcaucaacggcacgugcaccguggugaugaccgacggguccgccagcgagcgggcggacaccaagauccuguucaucgaggagggcaagaucguccacaucucgccccuguccggcagcgcccagcacguggaggagugcuccugcuacccccgcuacccgggggugcggugcgucugccgcgacaacuggaagggcucgaaccggcccaucguggacaucaacgugaaggacuacuccaucgucagcuccuacgugugcucggggcucgugggcgacacgccccgcaagaacgacuccagcuccucguccuacugccugaaccccaacaacgaggagggcgggcacggcgucaaggggugggccuucgacgacggcaacgacguguggauggggcggaccaucagcgagaagcugcgcuccggcuacgagaccuucaaggucaucggcggguggucgaagccgaacuccaagcuccagaucaaccgccaggugaucguggaccggggcaaccggagcggguacuccggcaucuucucggucgagggcaagagcugcgugaaccgcugcuucuacguggagcugauccgggggcgcaagcaggagaccgaggucugguggacguccaacucgaucgugguguucugcggcaccuccgggaccuacggcaccgggagcuggcccgacggcgccgacaucaaccugaugcccaucuga

SEQ ID NO: 24505 - RNA, 1410 nt, Artificial Sequence
  derived and/or modified CDS sequence (AUadapt) from InfluenzaA__AFH00398__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggagcaagaacauccuccgcacccaggaguccgagugcgucugcaucaacggcacgugcaccguggugaugaccgacggcucggccuccgagcgggcggacaccaagauccuguucaucgaggaggggaagaucguccacaucagcccccugucgggcuccgcccagcacguggaggagugcucgugcuacccccgcuacccgggggugcggugcgucugccgcgacaacuggaagggcuccaaccggcccaucguggacaucaacgugaaggacuacagcaucgucuccucguacgugugcuccggccucgugggggacacgccccgcaagaacgacagcuccucguccagcuacugccugaaccccaacaacgaggagggcgggcacggcgucaaggggugggccuucgacgacggcaacgacguguggaugggccggaccaucuccgagaagcugcgcucgggguacgagaccuucaaggucaucggcgggugguccaagccgaacagcaagcuccagaucaaccgccaggugaucguggaccggggcaaccgguccggguacucgggcaucuucuccgucgagggcaagagcugcgugaaccgcugcuucuacguggagcugauccgggggcgcaagcaggagaccgaggucugguggacgucgaacuccaucgugguguucugcggcaccagcgggaccuacggcgccggguccuggcccgacggcgccgacaucaaccugaugcccaucuga

SEQ ID NO: 24506 - RNA, 1410 nt, Artificial Sequence
  derived and/or modified CDS sequence (AUadapt) from InfluenzaA__AFH00409__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacaacgagaacgccaccgccuccuucaucuacgacggccggcugguggacucgaucggguccuggagcaagaacauccuccgcacccaggaguccgagugcgucugcaucaacggcacgugcaccguggugaugaccgacggcucggccuccgggcgggcggacaccaagauccuguucaucgaggagggcaagaucguccacaucagcccccugucgggguccgcccagcacguggaggagugcucgugcuacccccgcuacccgggcgugcggugcgucugccgcgacaacuggaagggcuccaaccggcccaucguggacaucaacgugaaggacuacagcaucgucuccucguacgugugcuccgggcucgugggcgacacgccccgcaagaacgacagcuccucguccagcuacugccugaaccccaacaacgaggagggcgggcacggggucaagggcugggccuucgacgacggcaacgacguguggauggggcggaccaucuccgagaagcugcgcucgggcuacgagaccuucaaggucaucgggggcugguccaagccgaacagcaagcuccagaucaaccgccaggugaucguggaccgggggaaccgguccggcuacucgggcaucuucuccgucgagggcaagagcugcaucaaccgcugcuucuacguggagcugauccgggggcgcaagcaggagaccgaggugugguggacgucgaacuccaucgucguguucugcgggaccagcggcaccuacgggaccggcuccuggcccgacggcgccgacaucaaccugaugcccaucuga

SEQ ID NO: 24507 - RNA, 1410 nt, Artificial Sequence; identical to SEQ ID NO: 17382
  derived and/or modified CDS sequence (AUadapt) from InfluenzaA__AFH00420__NA

SEQ ID NO: 24508 - RNA, 1410 nt, Artificial Sequence; identical to SEQ ID NO: 17515
  derived and/or modified CDS sequence (AUadapt) from InfluenzaA__AFH00431__NA

SEQ ID NO: 24509 - RNA, 1410 nt, Artificial Sequence
  derived and/or modified CDS sequence (AUadapt) from InfluenzaA__AFH00442__NA
augaaccccaaccagaagaucaucaccaucggcucggugucccugaccaucgccacgaucugcuuccucaugcagaucgccauccuggucaucaccgugacccugcacuucaagcaguacgagugcaacucgccgcccaacaaccaggugaugcucugcgagcccaccaucaucgagcgcaacaucacggagaucgucuaccugaccaacaccaccaucgagaaggagaucugccccaagcuggcggaguaccggaacugguccaagccgcagugcaagaucacgggguucgcccccuucagcaaggacaacuccauccgccucucggccggcggggacaucugggugacccgggagcccuacguguccugcgaccccggcaagugcuaccaguucgcccuggggcagggcaccacccugaacaaccgccacagcaacgacacgguccacgaccggaccccguaccgcacccuccugaugaacgagcugggcgugcccuuccaccucgggaccaagcaggucugcaucgccugguccucguccagcugccacgacggcaaggcguggcugcacgugugcgugacggggcacaacgagaacgccaccgccuccuucaucuacgacggccggcugguggacucgaucggguccuggagcaagaacauccuccgcacccaggaguccgagugcgucugcaucaacgggaccugcacgguggugaugaccgacggcucggccuccgggcgggcggacaccaagauccuguucaucgaggagggcaagaucguccacaucagcccccugucgggguccgcccagcacguggaggagugcucgugcuacccccgcuacccgggcgugcggugcgucugccgcgacaacuggaagggcuccaaccggcccaucguggacaucaacgugaaggacuacagcaucgucuccucguacgugugcuccgggcucgugggcgacacgccccgcaagaacgacagcuccucguccagccacugccugaaccccaacaacgaggagggcggccacggggucaagggcugggccuucgacgacggcaacgacguguggauggggcggaccaucuccgagaagcugcgcucgggcuacgagaccuucaaggucaucgggggcugguccaagccgaacagcaagcuccagaucaaccgccaggugaucguggaccgggggaaccgguccggcuacucgggcaucuucuccgucgagggcaagagcugcaucaaccgcugcuucuacguggagcugauccgggggcgcaagcaggagaccgaggugugguggaccucgaacuccaucgucguguucugcgggacgagcggcaccuacgggaccggcuccuggcccgacggcgccgacaucaaccugaugcccaucuga

SEQ ID NO: 24510 - RNA, 1410 nt, Artificial Sequence
  derived and/or modified CDS sequence (AUadapt) from InfluenzaA__AFH00453__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgaggucguguaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacgucuccugcgaccccgacaagugcuaccaguucgcccugggccaggggaccacgcugaacaaccgccacagcaacgacaucgugcacgaccggaccccguaccgcacccuccugaugaacgagcugggcgugcccuuccaccucggcaccaagcaggucugcaucgccugguccucguccagcugccacgacgggaaggcguggcugcacgugugcgugacgggccacgacgagaacgccaccgccuccuucaucuacgacgggcggcuggucgacucgaucggcuccuggagcaagaagauccuccgcacccaggaguccgagugcgugugcaucaacgggaccugcacgguggucaugaccgacggcucggccuccggccgggcggacaccaagauccuguucaucgaggaggggaagaucgugcacaucagcccccugucgggcuccgcccagcacguggaggagugcucgugcuacccccgcuacccggggguccggugcgugugccgcgacaacuggaagggcuccaaccggcccaucguggacaucaacgucaaggacuacagcaucguguccucguacgugugcuccggccucgucggggacacgccccgcaagaacgacagcuccucguccagccacugccugaaccccaacaacgaggagggcgggcacggcgugaaggggugggccuucgacgacggcaacgacgucuggaugggccggaccaucuccgagaagcugcgcucgggguacgagaccuucaaggugaucggcgggugguccaagccgaacagcaagcuccagaucaaccgccaggugaucgucgaccggggcaaccgguccggguacucgggcaucuucuccguggagggcaagagcugcaucaaccgcugcuucuacguggagcugauccgggggcgcaagcaggagaccgaggucugguggaccucgaacuccaucgugguguucugcggcacgagcgggaccuacggcaccggguccuggcccgacggcgccgacaucaaccugaugcccaucuga

SEQ ID NO: 24511 - RNA, 1410 nt, Artificial Sequence
  derived and/or modified CDS sequence (AUadapt) from InfluenzaA__AFH00464__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaagaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacggcgggcggcugguggacucgaucggcuccuggagcaagaagauccuccgcacccaggaguccgagugcgucugcaucaacggcacgugcaccguggugaugaccgacgggucggccuccggccgggcggacaccaagauccuguucaucgaggaggggaagaucguccacaucagcccccugucgggcuccgcccagcacguggaggagugcucgugcuacccccgcuacccgggcgugcggugcgucugccgcgacaacuggaagggguccaaccggcccaucguggacaucaacgugaaggacuacagcaucgucuccucguacgugugcuccggccucgugggggacacgccccgcaagaacgacagcuccucguccagcuacugccugaaccccaacaacgaggagggcgggcacggcgucaagggcugggccuucgacgacgggaacgacguguggaugggccggaccaucuccgagaagcugcgcucgggguacgagaccuucaaggucaucggcgggugguccaagccgaacagcaagcuccagaucaaccgccaggugaucguggaccggggcaaccgguccggcuacucggggaucuucuccgucgagggcaagagcugcaucaaccgcugcuucuacguggagcugauccgggggcgcaagcaggagaccgaggugugguggacgucgaacuccaucgucguguucugcggcaccagcgggaccuacggcaccggcuccuggcccgacggggccgacaucaaccugaugcccaucuga

SEQ ID NO: 24512 - RNA, 1410 nt, Artificial Sequence
  derived and/or modified CDS sequence (AUadapt) from InfluenzaA__AFH00475__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcaaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccucguccucgugccacgacgggaaggcguggcugcacgugugcgugaccggccacgacgagaacgccaccgccuccuucaucuacgacgggcggcugguggacagcaucggcuccuggucgaagaagauccuccgcacccaggaguccgagugcgucugcaucaacgggacgugcaccguggugaugaccgacggcagcgccuccggccgggcggacaccaagauccuguucaucgaggaggggaagaucguccacaucucgccccugagcggcuccgcccagcacguggaggagugcucgugcuacccccgcuacccgggggugcggugcgucugccgcgacaacuggaagggcuccaaccggcccaucguggacaucaacgugaaggacuacucgaucgucuccagcuacgugugcuccggccucgugggggacacgccccgcaagaacgacucguccagcuccucgcacugccugaaccccaacaacgaggagggcgggcacggcgucaaggggugggccuucgacgacggcaacgacguguggaugggccggaccaucuccgagaagcugcgcucgggguacgagaccuucaaggucaucgagggcugguccaagccgaacagcaagcuccagaucaaccgccaggugaucguggaccgggggaaccgguccggcuacucggggaucuucuccgucgagggcaagagcugcaucaaccgcugcuucuacguggagcugauccggggccgcaagcaggagaccgaggugugguggacgucgaacuccaucgucguguucugcgggaccagcggcaccuacgggaccggcuccuggcccgacggggccgacaucaaccugaugcccaucuga

SEQ ID NO: 24513 - RNA, 1410 nt, Artificial Sequence
  derived and/or modified CDS sequence (AUadapt) from InfluenzaA__AFH00486__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccucguccucgugccacgacgggaaggcguggcugcacgugugcgugaccggccacgacgagaacgccaccgccuccuucaucuacgacgggcggcugguggacagcaucggcuccuggucgaagaagauccuccgcacccaggaguccgagugcgucugcaucaacgggacgugcaccguggugaugaccgacggcagcgccuccggccgggcggacaccaagauccuguucaucgaggaggggaagaucguccacaucucgccccugcucggcagcgcccagcacguggaggagugcuccugcuacccccgcuacccgggggugcggugcgucugccgcgacaacuggaagggcucgaaccggcccaucguggacaucaacgugaaggacuacuccaucgucucguccuacgugugcagcggccuggugggggacacgccccgcaagaacgacuccucguccagcucccacugccugaaccccaacaacgaggagggcgggcacggcgucaaggggugggccuucgacgacggcaacgacguguggaugggccggaccaucucggagaagcuccgcuccggguacgagaccuucaaggucaucgagggcuggucgaagccgaacuccaagcugcagaucaaccgccaggugaucguggaccgggggaaccggagcggcuacuccgggaucuucucggucgagggcaaguccugcaucaaccgcugcuucuacguggagcugauccggggccgcaagcaggagaccgaggugugguggacgagcaacucgaucgucguguucugcgggaccuccggcaccuacgggaccggcagcuggcccgacggggccgacaucaaccucaugcccaucuga

SEQ ID NO: 24514 - RNA, 1410 nt, Artificial Sequence
  derived and/or modified CDS sequence (AUadapt) from InfluenzaA__AFH00497__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucaagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggagcaagaacauccuccgcacccaggaguccgagugcgucugcaucaacggcacgugcaccguggugaugaccgacggcucggccuccgagcgggcggacaccaagauccuguucaucgaggaggggaagaucguccacaucagcccccugucgggcuccgcccagcacguggaggagugcucgugcuacccccgcuacccgggggugcggugcgucugccgcgacaacuggaagggcuccaaccggcccaucguggacaucaacgugaaggacuacagcaucgucuccucguacgugugcuccggccucgugggggacacgccccgcaagaacgacagcuccucguccagcuacugcuggaaccccaacaacgagaagggcgggcacggcgucaaggggugggccuucgacgacggcaacgacguguggaugggccggaccaucuccgaggagcugcgcucgggguacgagaccuucaaggucaucggcgggugguccaagccgaacagcaagcugcagaucaaccgccaggugaucguggaccggggcaaccgguccggguacucgggcaucuucuccgucgagggcaagagcugcaucaaccgcugcuucuacguggagcucauccgggggcgcaagcaggagaccgaggugugguggacgucgaacuccaucgucguguucugcggcaccagcgggaccuacggcaccggguccuggcccgacggcgccgacaucaaccugaugcccaucuga

SEQ ID NO: 24515 - RNA, 1410 nt, Artificial Sequence
  derived and/or modified CDS sequence (AUadapt) from InfluenzaA__AFH00508__NA
augaaccccaaccagaagaucaucaccaucggcucggugucccugaccaucgccacgaucugcuuccucaugcagaucgccauccuggucaucaccgugacccugcacuucaagcaguacgagugcaacucgccgcccaacaaccaggugaugcucugcgagcccaccaucaucgagcgcaacaucacggagaucgucuaccugaccaacaccaccaucgagaaggagaucugccccaagcuggcggaguaccggaacugguccaagccgcagugcaagaucacgggguucgcccccuucagcaaggacaacuccauccgccucucggccggcggggacaucugggugacccgggagcccuacguguccugcgaccccggcaagugcuaccaguucgcccuggggcagggcaccacccugaacaaccgccacagcaacgacacgguccacgaccggaccccguaccgcacccuccugaugaacgagcugggcgugcccuuccaccucgggaccaagcaggucugcaucgccugguccucguccagcugccacgacggcaaggcguggcugcacgugugcgugacggggcacaacgagaacgccaccgccuccuucaucuacgacggccggcugguggacucgaucggguccuggagcaagaacauccuccgcacccaggaguccgagugcgucugcaucaacgggaccugcacgguggugaugaccgacggcucggccuccgggcgggcggacaccaagauccuguucaucgaggagggcaagaucguccacaucagcccccugucgggguccgcccagcacguggaggagugcucgugcuacccccgcuacccgggcgugcggugcgucugccgcgacaacuggaagggcuccaaccggcccaucguggacaucaacgugaaggacuacagcaucgucuccucguacgugugcuccgggcucgugggcgacacgccccgcaagaacgacagcuccucguccagccacugccugaaccccaacaacgaggagggcggccacggggucaagggcugggccuucgacgacggcaacgacguguggauggggcggaccaucuccgagaagcugcgcucgggcuacgagaccuuccgggucaucgggggcugguccaagccgaacagcaagcuccagaucaaccgccaggugaucguggaccgggggaaccgcuccggcuacucgggcaucuucuccgucgagggcaagagcugcaucaaccggugcuucuacguggagcugauccgcgggcgcaagcaggagaccgaggugugguggaccucgaacuccaucgucguguucugcgggacgagcggcaccuacgggaccggcuccuggcccgacggcgccgacaucaaccugaugcccaucuga

SEQ ID NO: 24516 - RNA, 1410 nt, Artificial Sequence
  derived and/or modified CDS sequence (AUadapt) from InfluenzaA__AFH00519__NA
augaaccccaaccagaagaucaucaccaucggcucggugucccugaccaucgccacgaugugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaacggccacagcaacgacaccguccacgaccgcaccccguaccggacccuccugaugaacgagcugggggugcccuuccaccucggcacgaagcaggucugcaucgccugguccucguccucgugccacgacgggaaggcguggcugcacgugugcgugaccggccacgacgagaacgccaccgccuccuucaucuacgacgggcgccugguggacagcaucggcuccuggucgaagaacauccuccggacccaggaguccgagugcgucugcaucaacggcacgugcaccguggugaugaccgacgggagcgccuccggccgcgcggacaccaagauccuguucaucgaggaggggaagaucguccacaucucgccccugagcggcuccgcccagcacguggaggagugcucgugcuacccccgguacccgggcgugcgcugcgucugccgggacaacuggaagggguccaaccgccccaucguggacaucaacgugaaggacuacucgaucgucuccagcuacgugugcuccggccucgugggggacacgccccggaagaacgacucguccagcuccucgcacugccugaaccccaacaacgaggagggcgggcacggcgucaagggcugggccuucgacgacgggaacgacguguggaugggccgcaccaucuccgagaagcugcggucgggguacgagaccuucaaggucaucggcgggugguccaagccgaacagcaagcuccagaucaaccgccaggugaucguggaccggggcaaccgcuccggcuacucggggaucuucuccgucgagggcaagagcugcaucaaccggugcuucuacguggagcugauccgcgggcggaagcaggagaccgaggugugguggacgucgaacuccaucgucguguucugcggcaccagcgggaccuacggcaccggcuccuggcccgacggggccgacaucaaccugaugcccaucuga

SEQ ID NO: 24517 - RNA, 1410 nt, Artificial Sequence; identical to SEQ ID NO: 16975
  derived and/or modified CDS sequence (AUadapt) from InfluenzaA__AFH00530__NA

SEQ ID NO: 24518 - RNA, 1410 nt, Artificial Sequence; identical to SEQ ID NO: 16975
  derived and/or modified CDS sequence (AUadapt) from InfluenzaA__AFH00541__NA

SEQ ID NO: 24519 - RNA, 1410 nt, Artificial Sequence
  derived and/or modified CDS sequence (AUadapt) from InfluenzaA__AFH00552__NA
augaaccccaaccagaagaucaucaccaucggcucggugucccugaccaucgccacgaucugcuuccucaugcagaucgccauccuggucaccaccgugacccugcacuucaagcaguacgagugcaacagccucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucucgaaggacaacuccauccgccugagcgccggcggggacaucugggugacccgggagcccuacguguccugcgaccccgacaagugcuaccaguucgcccugggccaggggaccacgcucaacaaccgccacucgaacgacaccguccacgaccggacccccuaccgcacccugcugaugaacgagcucggcgugccguuccaccugggcacgaagcaggucugcaucgccugguccagcuccucgugccacgacgggaaggcguggcugcacgugugcgugaccggccacgacgagaacgccaccgccuccuucaucuacgacgggcggcucguggacagcaucggcuccuggucgaagaagauccugcgcacccaggaguccgagugcgucugcaucaacgggacgugcaccguggugaugaccgacggcagcgccuccggccgggcggacaccaagauccuguucaucgaggaggggaagaucauccacaucucgcagcucagcggcuccacgcagcacgucgaggagugcucgugcuacccccgcuaccccggggugcggugcgugugccgcgacaacuggaagggcuccaaccggcccaucgucgacaucaacgugaaggacuacagcaucguguccucguacgucugcuccggccuggugggggacaccccgcgcaagaacgacagcuccucguccagccacugccugaaccccaacaacgaggagggcgggcacggcgugaaggggugggccuucgacgacggcaacgacgucuggaugggccggaccaucuccgagaaguuccgcucgggguacgagaccuucaaggugaucgagggcugguccaagcccaacagcaagcuccagaucaaccggcaggucaucguggaccgcgacaaccgguccggguacucgggcaucuucuccguggagggcaagagcugcaucaaccgcugcuucuacgucgagcugauccgggggcgcaagcaggagacggaggugugguggaccucgaacuccaucguggucuucugcggcaccagcgggaccuacggcacgggguccuggcccgacggcgccgacaucaaccugaugccgaucuga

SEQ ID NO: 24520 - RNA, 1410 nt, Artificial Sequence
  derived and/or modified CDS sequence (AUadapt) from InfluenzaA__AFH00563__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgagcgcaccccguaccggacccuccugaugaacgagcugggcgugcccuuccaccucgggacgaagcaggucugcaucgccugguccagcuccucgugccacgacggcaaggcguggcugcacgugugcgugaccggggacgacgagaacgccaccgccuccuucaucuacaacggccgccugguggacagcaucggguccuggucgaagaagauccuccggacccaggaguccgagugcgucugcaucaacggcacgugcaccguggugaugaccgacggcucggccuccgggaaggcggacaccaagauccuguucaucgaggagggcaagaucguccacacgagcccccugucgggguccgcccagcacguggaggagugcucgugcuacccccgcuacccgggcgugcggugcgucugccgcgacaacuggaagggcuccaaccggcccaucguggacaucaacgugaaggacuacagcaucgucuccucguacgugugcuccgggcucgugggcgacacgccccgcaagaacgacagcuccucguccucgcacugccuggaccccaacaacgaggagggcgggcacggggucaagggcugggccuucgacgacggcaacgacguguggauggggcggaccaucuccgagaagcugcgcagcggcuacgagaccuucaaggucaucgaggggugguccaagccgaacucgaagcuccagaucaaccgccaggugaucguggaccggggcaaccgguccggguacucgggcaucuucuccgucgagggcaagagcugcaucaaccgcugcuucuacguggagcugauccgggggcgcaagcaggagaccgaggugcuguggaccucgaacuccaucgucguguucugcggcaccagcgggaccuacggcacgggguccuggcccgacggcgccgacaucaaccucaugcccaucuga

SEQ ID NO: 24521 - RNA, 1410 nt, Artificial Sequence
  derived and/or modified CDS sequence (AUadapt) from InfluenzaA__AFH00574__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccaagaucaucgagcgcaacaucacggagaucgucuaccugaacaacaccaccaucgagaaggagaucugccccaagcuggcggaguaccggaacugguccaagccgcagugcaacaucaccggguucgcccccuucagcaaggacaacuccauccgccucucggccggcggggacaucugggugacgcgggagcccuacguguccugcgaccccgacaagugcuaccaguucgcccugggccaggggaccacccugaacaacggccacagcaacgacaccguccacgaccgcacgccguaccggacccuccugaugaacgagcugggcgugcccuuccaccucgggaccaagcaggucugcaucgccugguccucguccucgugccacgacggcaaggcguggcugcacgugugcgugaccggggacgacgagaacgccacggccuccuucaucuacaacggccgccugguggacagcaucggguccuggucgaagaagauccuccggacccaggaguccgagugcgucugcaucaacgggaccugcaccguggugaugacggacggcagcgccuccgggaaggcggacaccaagauccuguucaucgaggagggcaagaucguccacaccucgcugcucagcggguccgcccagcacguggaggagugcucgugcuacccccgcuaccccggcgugcggugcgucugccgcgacaacuggaagggcuccaaccggccgaucguggacaucaacgugaaggacuacucgaucgucuccagcuacgugugcuccgggcuggugggcgacacgccccgcaagaacgacucguccagcuccucgcacugccuggaccccaacaacgaggagggcggccacggggucaagggcugggccuucgacgacggcaacgacguguggauggggcggaccaucuccgagaagcuccgcucgggcuacgagaccuucaaggucaucgaggggugguccaagcccaacagcaagcugcagaucaaccgccaggugaucguggaccggggcaaccgguccggguacucgggcaucuucuccgucgagggcaagagcugcaucaaccgcugcuucuacguggagcugauccgggggcgcaagcaggagaccgaggugcucuggaccucgaacuccaucgucguguucugcggcacgagcgggaccuacggcaccggguccuggccggacggcgccgacaucaaccugaugcccaucuga

SEQ ID NO: 24522 - RNA, 1410 nt, Artificial Sequence
  derived and/or modified CDS sequence (AUadapt) from InfluenzaA__AFH00585__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucaagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaaccgccacagcaacgacaagguccacgaccggaccccguaccgcacccuccugaugaacgagcugggcgugcccuuccaccucggcaccaagcaggucugcaucgccugguccucguccagcugccacgacgggaaggcguggcugcacgugugcgugacgggcgacgacgagaacgccaccgccuccuucaucuacaacgggcggcugguggacucgaucggcuccuggucgaagaagauccuccgcacccaggaguccgagugcgucugcaucaacgggaccugcacgguggugaugaccgacggcagcgccuccggcaaggcggacaccaagauccuguucaucaaggaggggaagaucguccacaccucgagccuguccggcucggcccagcacguggaggagugcuccugcuacccccgguaccccggggugcgcugcgucugccgggacaacuggaagggcagcaaccgcccgaucguggacaucaacgugaaggacuacuccaucgucucguccuacgugugcagcggccucgugggggacacgccccggaagaacgacuccucguccucgucccacugccuggaccccaacaacgaggagggcgggcacggcgucaaggggugggccuucgacgacggcaacgacguguggaugggccgcaccaucagcgagaagcugcgguccggguacgagaccuucaaggucaucgagggcuggucgaaggccaacuccaagcuccagaucaaccgccaggugaucguggaccgggggaaccgcagcggcuacuccgggaucuucucggucgagagcaaguccugcaucaaccggugcuucuacguggagcugauccgcggccggaagcaggagaccgaggugcuguggacgucgaacuccaucgucguguucugcggcaccagcgggaccuacggcaccggguccuggcccgacggcgccgacaucaaccucaugccgaucuga

SEQ ID NO: 24523 - RNA, 1410 nt, Artificial Sequence; identical to SEQ ID NO: 17110
  derived and/or modified CDS sequence (AUadapt) from InfluenzaA__AFH00596__NA

SEQ ID NO: 24524 - RNA, 1410 nt, Artificial Sequence
  derived and/or modified CDS sequence (AUadapt) from InfluenzaA__AFH00607__NA
augaaccccaaccagaagaucaucaccaucggcuucguguucuucaccaucgccacgaucugcuuccugaugcagaucgccauccucgucaccaccgugacccugcacuucaagcaguacgagugcaacccgccgcccaacaaccaggugaugcugugcgagcccacgaucaucgagcgcaacaucaccgagaucgucuaccucaccaacaccacgaucgagaaggagaucugccccaagcuggcggaguaccggaacuggucgaagccccagugcaacaucaccggguucgcccccuucuccaaggacaacagcauccgccuguccgccggcggggacaucugggugacccgggagcccuacgugucgugcgacccggacaagugcuaccaguucgcccucggccaggggaccacgcugaacaacggccacuccaacgacaccguccacgaccgcacccccuaccggacccugcucaugaacgagcugggcgugcccuuccaccuggggacgcgccaggugugcaucgccuggagcuccucguccugccacgacggcaaggcguggcuccacgucugcgugaccggggacgacgagaacgccaccgccagcuucaucuacaacggccggcugguggacuccaucgggucgugguccaagaagauccugcgcacccaggagagcgagugcgucugcaucaacggcacgugcaccguggugaugaccgacggcuccgccucggggaaggcggacaccaagauccucuucaucgaggagggcaagaucguccacaucuccacgcugagcggguccgcccagcacguggaggagugcagcugcuacccccgguacccgggcgugcgcugcgucugccgggacaacuggaagggcucgaaccgccccaucguggacaucaacgugaaggacuacuccaucgucagcuccuacgugugcucggggcuggugggcgacacgccccggaagaacgacuccuucagcuccucgcacugccucgaccccaacaacgaggagggcgggcacggggucaagggcugggccuucgacgacggcaacgacguguggauggggcgcaccaucuccgagaagcugcggagcggcuacgagaccuucaaggucaucgaggggugguccaagccgaacucgaagcugcagaccaaccgccaggugaucguggagcggggcaaccgcuccggguacagcggcaucuucuccgucgagggcaagucgugcaucaaccggugcuucuacguggagcucauccgcgggcggaaggaggagaccgaggugugguggaccuccaacagcaucgucguguucugcggcaccuccgggacguacggcaccgggagcuggcccgacggcgccgacaucaaccugaugcccaucuga

SEQ ID NO: 24525 - RNA, 1410 nt, Artificial Sequence; identical to SEQ ID NO: 18331
  derived and/or modified CDS sequence (AUadapt) from InfluenzaA__AFH00618__NA

SEQ ID NO: 24526 - RNA, 1410 nt, Artificial Sequence
  derived and/or modified CDS sequence (AUadapt) from InfluenzaA__AFH00629__NA
augaaccccaaccagaagaucaucaccaucggcucggugucccugaccaucgccacgaucugcuuccucaugcagaucaccauccuggucaccaccgugacgcugcacuucaagcaguacgagugcaacucgccgcccaacaaccaggugaugcucugcgagcccaccaucaucgagcgcaacaucaccgagaucgucuaccugaccaacacgaccaucgagaaggggaucugccccaagcuggccgaguaccggaacugguccaagccgcagugcaacaucaccggcuucgcgcccuucagcaaggacaacuccauccgccucucggccgggggcgacaucugggugacccgggagcccuacguguccugcgaccccgacaagugcuaccaguucgcccuggggcagggcacgacccugaacaacggccacagcaacgacaccguccacgaccgcaccccguaccggacgcuccugaugaacgagcugggggugcccuuccaccucggcacccgccaggugugcaucgccugguccucguccucgugccacgacgggaaggccuggcugcacgucugcgugaccggcgacgacaagaacgcgaccgccuccuucaucuacaacgggcggcugguggacagcaucggcuccuggucgaagaagauccuccgcacgcaggaguccgagugcgucugcaucaacgggaccugcaccguggugaugaccgacggcagcgccuccggcaaggccgacacgaagauccuguucaucgaggaggggaagaucauccacaucucgacccugcucggcagcgcgcagcacgucgaggagugcuccugcuacccccgguaccccggcgugcgcugcgugugccgggacaacuggaaggggucgaaccgcccgaucgucgacaucaacgugaaggacuacuccaucgugucguccuacgucugcagcggccuggugggggacacgccccggaagaacgacuccucguccagcucccacugccuggaccccaacaacgaggagggcgggcacggcgugaagggcugggccuucgacgacgggaacgacgucuggaugggccgcaccaucucggagaagcuccgguccggguacgagaccuucaaggugaucgagggcuggucgaagcccaacuccaagcugcagaucaaccgccaggucaucguggagcgggggaaccgcagcggcuacuccggcaucuucucgguggaggggaaguccugcaucaaccggugcuucuacgucgagcugauccgcggccggaaggaggagaccgaggugugguggaccagcaacucgaucguggucuucugcgggaccuccggcacguacgggaccggcagcuggccggacggcgccgacaucaaccucaugcccaucuga

SEQ ID NO: 24527 - RNA, 1410 nt, Artificial Sequence; identical to SEQ ID NO: 16729
  derived and/or modified CDS sequence (AUadapt) from InfluenzaA__AFH00640__NA

SEQ ID NO: 24528 - RNA, 1410 nt, Artificial Sequence; identical to SEQ ID NO: 18858
  derived and/or modified CDS sequence (AUadapt) from InfluenzaA__AFH00651__NA

SEQ ID NO: 24529 - RNA, 1410 nt, Artificial Sequence; identical to SEQ ID NO: 16729
  derived and/or modified CDS sequence (AUadapt) from InfluenzaA__AFH00662__NA

SEQ ID NO: 24530 - RNA, 1410 nt, Artificial Sequence
  derived and/or modified CDS sequence (AUadapt) from InfluenzaA__AFH00673__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccacgaucaucgagcgcaacaucaccgagaucguguaccucaccaacaccacgaucgagaaggagaccugccccaagcuggccgaguaccggaacugguccaagccgcagugcgacaucaccggguucgcgcccuucagcaaggacaacuccauccgccugucggccggcggggacaucugggucacccgggagcccuacguguccugcgaccccgacaagugcuaccaguucgcccucggccaggggacgacccugaacaacgugcacagcaacgacaccguccacgaccgcaccccguaccggacgcugcucaugaacgagcugggcgugcccuuccaccugggcaccaagcaggucugcaucgccugguccucguccagcugccacgacgggaaggccuggcuccacgugugcgugaccggcgacgacaagaacgcgaccgccuccuucaucuacaacgggcgccugguggacagcaucgucuccuggucgaaggagauccugcggacgcaggaguccgagugcgugugcaucaacgggaccugcaccguggucaugaccgacgggagcgccucgggcaaggccgacacgaagauccucuucaucgaggagggcaagaucgugcacaccuccacccugagcggguccgcgcagcacguggaggagugcucgugcuacccccgcuaccccggcguccggugcgugugccgcgacaacuggaagggguccaaccggccgaucguggacaucaacaucaaggacuacagcaucgucucccgcuacgugugcucgggccuggugggcgacacgccccggaagaacgacuccagcuccagcucccacugccucgaccccaacaacgaggagggcggccacggggucaagggcugggccuucgacgacgggaacgacguguggaugggccgcaccaucucggucaagucccggagcggcuacgagaccuucaaggugaucgaggggugguccaaccccaacucgaagcugcagaucaaccgccaggugaucgucgaccggggcaaccgcuccggguacagcggcaucuucucgguggaggggaaguccugcaucaaccggugcuucuacguggagcugauccgcggccggaaggaggagaccgagguccucuggaccagcaacuccaucgugguguucugcggcacgagcgggaccuacggcaccggguccuggccggacggcgccgacaucaaccugaugcccaucuga

SEQ ID NO: 24531 - RNA, 1410 nt, Artificial Sequence
  derived and/or modified CDS sequence (AUadapt) from InfluenzaA__AFH00684__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgagcggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 24532 - RNA, 1410 nt, Artificial Sequence
  derived and/or modified CDS sequence (AUadapt) from InfluenzaA__AFH00695__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgagcggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 24533 - RNA, 1410 nt, Artificial Sequence
  derived and/or modified CDS sequence (AUadapt) from InfluenzaA__AFH00706__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaugaaggaccacuccaucgucagcuccuacgugugcucgggccuggugggcgacacgccccggaagaacgacuccagcuccucgucccacugcuucgaccccaacaacgaggagggcgggcacggggucaagggcugggccuucgacgacgggaacgacguguggaugggccgcaccaucagcgagaagucccggcucggcuacgagaccuucaaggucaucgagggguggagcaaccccaaguccaagcugcagaucaaccgccaggugaucguggaccggggcgaccgcucgggguacuccggcaucuucagcgucgagggcaagucgugcaucaaccggugcuucuacguggagcugauccgcggguccaaggaggagaccgaggugcucuggaccagcaacuccaucgucguguucugcggcaccagcgggacguacggcaccggguccuggccggacggcgccgacaucaaccugaugcccaucuga

SEQ ID NO: 24534 - RNA, 1410 nt, Artificial Sequence
  derived and/or modified CDS sequence (AUadapt) from InfluenzaA__AFH00728__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacucgauccgccuguccgccggcggggacaucugggugacccgggagcccuacgucagcugcgacccgggcaagugcuaccaguucgcccucgggcagggcaccacccugaacaacaagcacuccaacgacacgauccacgaccgcacccccuaccggacccugcucaugaacgagcugggcgugcccuuccaccuggggacccgccaggugugcaucgccuggucguccagcuccugccacgacggcaaggccuggcuccacgucugcgugacggggcacgacaagaacgcgaccgccucguucaucuacaacggccggcugguggacuccaucgggagcugguccaagaacauccugcgcacccaggagucggagugcgucugcaucaacgggaccugcacgguggugaugaccgacggcuccgccagcgagcgggccgacaccaagauccucuucaucgaggagggcaagaucguccacaucucgccccuguccggcucggcgcagcacguggaggagugcuccugcuacccgcgcuaccccggggugcggugcgucugccgcgacaacuggaagggcagcaaccggcccaucguggacaucaacgugaaggacuacuccaucgucucguccuacgugugcagcggccuggugggggacacgccccgcaagaacgaccgguccucguccagcuacugccgcaacccgaacaacgagaagggcaaccacggggucaagggcugggccuucgacgacgggaacgacguguggaugggccggaccaucggcgaggagcuccgcuccggguacgagaccuucaaggucaucggcggguggucgacccccaacuccaagcugcagaucaaccgccaggugaucguggacagcgacaaccgguccggcuacucggggaucuucuccgucgagggcaagagcugcaucaaccggugcuucuacguggagcugauccgcggccgcgagcaggagacccgggugcucuggacgucgaacuccaucgucguguucugcgggaccagcggcaccuacgggaccggcuccuggcccgacggggccgacaucaaccugaugcccaucuga

SEQ ID NO: 24535 - RNA, 1410 nt, Artificial Sequence
  derived and/or modified CDS sequence (AUadapt) from InfluenzaA__AFH00739__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacucgauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggucguccagcuccugccacgacggcaaggccuggcuccacgugugcgugaccgggcacgacaagaacgcgaccgccucguucaucuacgacggccggcuggucgacuccaucgggucgugguccaagaacauccugcgcacccaggagagcgagugcgugugcaucaacggcacgugcaccguggucaugaccgacggcuccgccucggagcgggccgacaccaagauccucuucaucgaggaggggaagaucgugcacaucagcccccuguccggcucggcgcagcacguggaggagugcuccugcuacccgcgcuaccccgggguccggugcgugugccgcgacaacuggaagggcagcaaccggcccaucguggacaucaacgucaaggacuacuccaucgugucguccuacgugugcagcggccuggucggggacacgccccgcaagaacgaccgguccucguccucguacugccgcaacccgaacaacgagaagggcucccacggggugaagggcugggccuucgacgacgggaacgacgucuggaugggccggaccaucggcgaggagcuccgcagcggguacgagaccuucaaggugaucggcgggugguccacccccaacucgaagcugcagaucaaccgccaggugaucgucgacuccggcaaccggagcggguacuccggcaucuucucgguggagggcaagagcugcaucaaccggugcuucuacguggagcugauccgcgggcgcggccaggagacgcgggucugguggaccuccaacucgaucgugguguucugcgggaccuccggcaccuacgggacgggcagcuggcccgacggcgccgacaucaaccucaugcccaucuga

SEQ ID NO: 24536 - RNA, 1410 nt, Artificial Sequence
  derived and/or modified CDS sequence (AUadapt) from InfluenzaA__AFH00750__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacucgauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggucguccagcuccugccacgacggcaaggccuggcuccacgugugcgugaccgggcacgacaagaacgcgaccgccucguucaucuacgacggccggcuggucgacuccaucgggagcugguccaagaacauccugcgcacccaggagucggagugcgugugcaucaacggcacgugcaccguggucaugaccgacggcuccgccagcgagcgggccuacaccaagauccucuucaucaaggaggggaagaucgugcacaucucgccccuguccggcagcgcgcagcacguggaggagugcuccugcuacccgcgcuaccccgggguccggugcgugugccgcgacaacuggaagggcucgaaccggcccaucguggacaucaacgucaaggacuacuccaucgugagcuccuacgugugcucgggccuggucggggacacgccccgcaagaacgaccgguccagcuccucguacugccgcaacccgaacaacgagaagggcucccacggggugaagggcugggccuucgacgacgggaacgacgucuggaugggccggaccaucggcgaggagcuccgcagcggguacgagaccuucaaggugaucggcgggugguccacccccaacucgaagcugcagaucaaccgccaggugaucgucgaguccggcaaccggagcggguacuccggcaucuucucgguggagggcaagagcugcaucaaccggugcuucuacguggagcugauccgcgggcgcgagcaggagacgcgggucugguggaccuccaacucgaucgugguguucugcggcaccuccgggaccuacggcacggggagcuggcccgacggcgccgacaucaaccucaugcccaucuga

SEQ ID NO: 24537 - RNA, 1410 nt, Artificial Sequence
  derived and/or modified CDS sequence (AUadapt) from InfluenzaA__AFH00761__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcccugcgagcccacgaucaucgagcgcaacaucaccgagaucgucuaccucaccaacaccacgaucgagaaggagaucugcccgaagcugguggaguaccggaacugguccaagccccagugcaagaucaccggguucgcgcccuucagcaaggacaacuccauccgccugucggccggcggggacaucugggugacccgggagcccuacgucuccugcgacccgggcaagugcuaccaguucgcccucgggcagggcaccacgcugaacaaccgccacagcaacgacaccgugcacgaccggacccccuaccgcacccugcucaugaacgagcugggcgugcccuuccaccuggggacgaagcaggucugcaucgccugguccucguccucgugccacgacggcaaggccuggcuccacgugugcgugaccgggcacgacgagaacgcgaccgccuccuucaucuacgacggccggcuggucgacagcaucggguccuggucgaagaacauccugcgcacccaggaguccgagugcgugugcaucaacggcacgugcaccguggucaugaccgacggcagcgccuccgagcgggccgacaccaagauccucuucaucgaggaggggaagaucgugcacaucucgccccugagcggcuccgcgcagcacguggaggagugcucgugcuacccgcgcuaccccgggguccggugcgugugccgcgacaacuggaagggcuccaaccggcccaucguggacaucaacgucaaggacuacucgaucguguccagcuacgugugcuccggccuggucggggacacgccccgcaagaacgacucguccagcuccucguacugccggaacccgaacaacgagaagggcucccacggggugaagggcugggccuucgacgacggggacgacgucuggaugggccgcaccaucggcgaggagcuccggucgggguacgagaccuucaaggugaucggcgggugguccacccccaacagcaagcugcagaucaaccgccaggugaucgucgaccggggcaaccgcuccggguacucgggcaucuucuccguggagggcaagagcugcaucaaccggugcuucuacguggagcugauccgcgggcgcaagcaggagacgaaggucugguggaccucgaacuccaucgugguguucugcggcaccagcgggaccuacggcacgggguccuggcccgacggcgccgacaucaaccucaugcccaucuga

SEQ ID NO: 24538 - RNA, 1410 nt, Artificial Sequence
  derived and/or modified CDS sequence (AUadapt) from InfluenzaA__AFH00783__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccgcgggaccacgcugaacaaccggcacagcaacgacaccguccacgaccgcaccccguaccggacccuccugaugaacgagcugggcgugcccuuccaccucggcacgaagcaggucugcaucgccugguccucguccagcugccacgacgggaaggcguggcugcacgugugcgugaccggccacgacgagaacgccaccgccuccuucaucuacgacgggcgccugguggacucgaucggcuccuggagcaagaagauccuccggacccaggaguccgagugcgucugcaucaacgggacgugcaccguggugaugaccgacggcucggccuccggccgcgcggacaccaagauccuguucaucgaggaggggaagaucguccacaucagcccccugucgggcuccgcccagcacguggaggagugcagcugcuacccccgguacuccggggugcgcugcgucugccgggacaacuggaagggcucgaaccgcccgaucguggacaucaacgugaaggacuacuccaucgucagcuccuacgugugcucgggccucgugggggacacgccccggaagaacgacuccagcuccucgucccacugccugaaccccaacaacgaggagggcgggcacggcgucaaggggugggccuucgacgacggcaacgacguguggaugggccgcaccaucagcgagaaguuccgguccggguacgagaccuucaaggucaucggcggguggucgaagcccaacuccaagcugcagaucaaccgccaggugaucguggaccggggcaaccgcagcggguacuccggcaucuucucggucgagggcaagagcugcaucaaccggugcuucuacguggagcucauccgcgggcgcaagcaggagaccgaggugugguggacguccaacucgaucgucguguucugcggcaccuccgggaccuacggcaccgggagcuggccggacggcgccgacaucaaccugaugcccaucuga

SEQ ID NO: 24539 - RNA, 1410 nt, Artificial Sequence
  derived and/or modified CDS sequence (AUadapt) from InfluenzaA__AFH00794__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucgccgccggcggggacaucugggugacccgggagcccuacgugucgugcgaccccgacaagugcuaccaguucgcccugggccaggggaccacgcugaacaaccgccacuccaacgacaccguccacgaccggaccccguaccgcacccuccugaugaacgagcugggcgugcccuuccaccucggcacgaagcaggucugcaucgcguggucguccagcuccugccacgacgggaaggccuggcugcacgugugcgugaccggccacgacgagaacgccaccgccucguucaucuacgacgggcggcugguggacuccaucggcucgugguccaagaagauccuccgcacccaggagagcgagugcgucugcaucaacgggacgugcaccguggugaugaccgacggcuccgcgucggagcgggccgacaccaagauccuguucaucgaggagggcaagaucguccacaucucccagcugucggggagcgcccagcacguggaggagugcuccugcuacccccgcuaccccggcgugcggugcgucugccgcgacaacuggaaggggucgaaccggccgaucguggacaucaacgugaaggacuacuccaucgucucguccuacgugugcagcggccucgugggcgacacgccccgcaagaacgacuccucguccucgucccacugccugaaccccaacaacgaggagggcgggcacggggucaagggcugggccuucgacgacggggacgacguguggaugggccggaccaucagcgagaagcugcgcuccggcuacgagaccuucaaggucaucgagggguggucgaagcccaacuccaagcuccagaccaaccgccaggugaucguggaccggggcaaccggucgggguacuccggcaucuucagcgucgaggggaaguccugcaucaaccgcugcuucuacguggagcugauccggggccgcaagcaggagacggaggugugguggaccucgaacucgaucgucguguucugcggcaccuccgggaccuacggcacggggagcuggccggacggcgccgacaucaaccugaugcccaucuga

SEQ ID NO: 24540 - RNA, 1410 nt, Artificial Sequence; identical to SEQ ID NO: 17890
  derived and/or modified CDS sequence (AUadapt) from InfluenzaA__AFH00805__NA

SEQ ID NO: 24541 - RNA, 1410 nt, Artificial Sequence; identical to SEQ ID NO: 21920
  derived and/or modified CDS sequence (AUadapt) from InfluenzaA__AFH00816__NA

SEQ ID NO: 24542 - RNA, 1410 nt, Artificial Sequence
  derived and/or modified CDS sequence (AUadapt) from InfluenzaA__AFH00827__NA
augaaccccaaccagaagaucaucaccaucggcucggugucccugaccaucucgacgaccugcuucuucaugcagaucgccauccucaucaccaccgucacgcugcacuucaagcaguacgaguucaacuccccgcccaacaaccaggugaugcugugcgagcccaccaucaucgagcgcaacaugaccgagaucguguaccucaccaacacgaccaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggacgacccucaacaacgugcacuccaacaacaccguccgcgaccggacccccuaccgcacgcugcugaugaacgagcucggcgugcccuuccaccugggcaccaagcaggucugcaucgccuggucguccucguccugccacgacgggaaggccuggcugcacgugugcaucaccggcgacgacaagaacgcgaccgccagcuucaucuacaacgggcggcucguggacuccguggucucgugguccaaggagauccugcgcacgcaggagagcgagugcgugugcaucaacgggaccugcaccguggucaugaccgacggguccgccucgggcaaggccgacacgaagauccuguucaucgaggagggcaagaucgugcacaccagcacccucuccgggucggcgcagcacguggaggagugcuccugcuacccccgguacccgggcguccgcugcgugugccgggacaacuggaaggggucgaaccgccccaucguggacaucaacaucaaggaccacuccaucgucagcuccuacgugugcucgggccuggugggcgacaccccgcggaagaacgacuccagcuccucgucccacugccuggaccccaacaacgaggagggcggccacggggucaagggcugggccuucgacgacgggaacgacguguggaugggccgcacgaucaacgagaccucgcggcucggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggacgucgaacuccaucgucguguucugcggcaccagcgggaccuacggcaccggguccuggcccgacggcgccgaccugaaccugaugccccucuga

SEQ ID NO: 24543 - RNA, 1410 nt, Artificial Sequence; identical to SEQ ID NO: 18331
  derived and/or modified CDS sequence (AUadapt) from InfluenzaA__AFH01410__NA

SEQ ID NO: 24544 - RNA, 1410 nt, Artificial Sequence
  derived and/or modified CDS sequence (AUadapt) from InfluenzaA__AFH34942__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccaagaucaucgagcgcaacaucacggagaucguguaccucaccaacaccaccaucgagaaggagaucugccccaagccggccgaguaccggaacuggagcaagccccagugcgacaucacgggguucgcgcccuucuccaaggacaacucgauccgccuguccgccggcggggacaucugggucacccgggagcccuacgugagcugcgacccggacaagugcuaccaguucgcccugggccaggggaccacccucaacaacgugcacuccaacaacacgguccgcaaccggacccccuaccgcacccugcugaugaacgagcucggcgugcccuuccaccugggcaccaagcaggucugcaucgccuggucguccagcuccugccacgacgggaaggccuggcugcacgugugcaucacgggcgacgacaagaacgcgaccgccucguucaucuacaacgggaagcucguggacuccguggucagcugguccaaggagauccugcggacccaggagucggagugcgugugcaucaacgggaccugcacgguggucaugaccgacggguccgccagcggcaaggccgacaccaagauccuguucaucgaggagggcaagaucgugcacaccucgacgcucuccgggucggcgcagcacguggaggagugcuccugcuacccccgcuacccgggcguccggugcgugugccgcgacaacuggaaggggagcaaccggcccaucguggacaucaacaucaaggaccacuccaucgucucguccuacgugugcagcggccuggugggcgacaccccgcgcaagaacgacuccucguccagcucccacugccuggaccccaacaacgaggagggcggccacggggucaagggcugggccuucgacgacgggaacgacguguggaugggccggaccaucaacgagaccucgcgccucggcuacgagacguucaaggucaucgaggggugguccaaccccaagagcaagcugcagaucaaccgccaggugaucguggaccggggcgaccgguccggguacucgggcaucuucuccgucgagggcaagagcugcaucaaccgcugcuucuacguggagcugauccgggggcgcaaggaggagaccgaggugcucuggaccucgaacuccaucgucguguucugcggcaccagcgggacguacggcaccggguccuggcccgacggcgccgaccugaaccugaugcccaucuga

SEQ ID NO: 24545 - RNA, 1410 nt, Artificial Sequence
  derived and/or modified CDS sequence (AUadapt) from InfluenzaA__AFH34956__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcggccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaacgaggugcucuggaccucgaacuccaucgucguguucugcgggaccagcggcacguacgggaccggcuccuggcccgacggggccgaccugaaccugaugcccaucuga

SEQ ID NO: 24546 - RNA, 1410 nt, Artificial Sequence
  derived and/or modified CDS sequence (AUadapt) from InfluenzaA__AFH34963__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggucgaagccccagugcgacaucaccggguucgcgcccuucuccaaggacaacagcauccgccuguccgccggcggggacaucugggucacccgggagcccuacgugucgugcgacccggacaagugcuaccaguucgcccugggccaggggaccacgcucaacaacgugcacuccaacaacaucguccgcgaccggacccccuaccgcacccugcugaugaacgagcucggcgugcccuuccaccugggcaccaagcaggucugcaucgccuggagcuccucguccugccacgacgggaaggccuggcugcacgugugcaucacgggcgacgacaagaacgcgaccgccagcuucaucuacaacgggcggcucguggacuccguggucucgugguccaaggagauccugcgcacccaggagagcgagugcgugugcaucaacgggaccugcacgguggucaugaccgacggguccgccucgggcaaggccgacaccaagauccuguucaucgaggagggcaagaucgugcacaccagcacgcucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcggccacggggucaagggcugggccuucgacgacgggaacgacguguggaugggccgcaccaucaacgagaccucgcggcucggcuacgagacguucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaacgaggugcucuggaccucgaacuccaucgucguguucugcggcaccagcgggaccuacggcacgggguccuggcccgacggcgccgaccugaaccugaugcccaucuga

SEQ ID NO: 24547 - RNA, 1410 nt, Artificial Sequence
  derived and/or modified CDS sequence (AUadapt) from InfluenzaA__AFH34970__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcuguacgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcgggcacggggucaagggcugggccuucgacgacgggaacgacguguggaugggccgcaccaucaacgagacgucgcggcucggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaacgaggugcucuggaccucgaacuccaucgucguguucugcggcaccagcgggacguacggcaccggguccuggcccgacggcgccgaccugaaccugaugcccaucuga

SEQ ID NO: 24548 - RNA, 1410 nt, Artificial Sequence; identical to SEQ ID NO: 16339
  derived and/or modified CDS sequence (AUadapt) from InfluenzaA__AFH34977__NA

SEQ ID NO: 24549 - RNA, 1410 nt, Artificial Sequence
  derived and/or modified CDS sequence (AUadapt) from InfluenzaA__AFH74468__NA
augaaccccaaccagaagaucaucaccaucggcucggugucccugaccaucucgacgaucugcuucuucaugcagaccgccauccucaucaccaccgucacgcugcacuucaagcagugcgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacgcaggagucggagugcgugugcaucaacgggaccugcaccguggucaugaccgacggcuccgccagcggcaaggccgacacgaagauccucuucaucgaggagggccggaucgugcacaccucgacccuguccgggagcgcgcagcacguggaggagugcuccugcuacccccgcuaccccggcguccggugcgugugccgcgacaacuggaaggggucgaaccggccgaucguggacaucaacaucaaggaccacuccaucgucagcuccuacgugugcucgggccuggugggcgacacgccccgcaagaacgacuccagcuccucgucccacugccucgaccccaacaacgaggagggggacaacggcgucaaggggugggccuucgacgacggcaacgacguguggauggggcggaccaucagcgagaagucccgccugggcuacgagaccuucaaggucaucgagggcuggucgaaccccaaguccaagcugcagaucaaccgccaggugaucguggaccgggggaaccggagcggcuacuccgggaucuucucggucgagggcaagagcugcaucaaccgcugcuucuacguggagcucauccgggggcgcaaggaggagaccgaggugcuguggaccuccaacucgaucgucguguucugcggcacguccggcaccuacgggaccggcagcuggccggacggggccgacaucaaccugaugcccaucuga

SEQ ID NO: 24550 - RNA, 1410 nt, Artificial Sequence; identical to SEQ ID NO: 21053
  derived and/or modified CDS sequence (AUadapt) from InfluenzaA__AFH74469__NA

SEQ ID NO: 24551 - RNA, 1410 nt, Artificial Sequence; identical to SEQ ID NO: 19001
  derived and/or modified CDS sequence (AUadapt) from InfluenzaA__AFH74480__NA

SEQ ID NO: 24552 - RNA, 1410 nt, Artificial Sequence; identical to SEQ ID NO: 19001
  derived and/or modified CDS sequence (AUadapt) from InfluenzaA__AFH74491__NA

SEQ ID NO: 24553 - RNA, 1410 nt, Artificial Sequence; identical to SEQ ID NO: 24044
  derived and/or modified CDS sequence (AUadapt) from InfluenzaA__AFH74502__NA

SEQ ID NO: 24554 - RNA, 1410 nt, Artificial Sequence
  derived and/or modified CDS sequence (AUadapt) from InfluenzaA__AFH74513__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaccugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacgcaggagucggagugcgugugcaucaacgggaccugcaccguggucaugaccgacggguccgccagcggcaaggccgacacgaagauccucuucaucgaggagggcaagaucgugcacaccucgacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccucgucccacugccucgaccccaacaacgaggagggcggccacggggucaagggcugggccuucgacgacgggaacgacguguggaugggccgcaccaucagcgagaagucccggcugggcuacgagaccuucaaggucaucgagggguggucgaaccccaaguccaagcugcagaucaaccgccaggugaucguggaccggggcaaccgcagcggguacuccggcaucuucucggucgagggcaagagcugcaucaaccggugcuucuacguggagcucauccgcgggcggaaggaggagaccgaggugcuguggaccuccaacucgaucgucguguucugcggcacguccgggaccuacggcaccgggagcuggccggacggcgccgacaucaaccugaugcccguguga

SEQ ID NO: 24555 - RNA, 1410 nt, Artificial Sequence
  derived and/or modified CDS sequence (AUadapt) from InfluenzaA__AFH74524__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgaucaacaacgugcacuccaacaacaccguccgcgaccggaccccguaccgcacccugcugaugaacgagcucggcgugcccuuccaccugggcacgaagcaggucugcaucgccuggagcuccucguccugccacgacgggaaggccuggcugcacgugugcaucaccggcgacgacaagaacgcgaccgccagcuucaucuacaacgggcggcucguggacuccguggucucgugguccaaggagauccugcgcacccaggagagcgagugcgugugcaucaacggcacgugcaccguggucaugaccgacggguccgccucgggcaaggccgacaccaagauccuguucaucgaggagggcaagaucgugcacacgagcacccucuccgggucggcgcagcacguggaggagugcuccugcuacccccgguaccccggcguccgcugcgugugccgggacaacuggaaggggagcaaccgcccgaucguggacaucaacaugaaggaccacuccaucgucucguccuacgugugcagcggccuggugggcgacacgccccggaagaacgacuccucguccagcucccacugccuggaccccaacaacgaggagggcgggcacggggucaagggcugggccuucgacgacgggaacgacguguggaugggccgcaccaucucggagaagucccggcucggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcugauccgcgggcggaaggaggagaccgaggugcucuggaccuccaacagcgucgugguguucugcggcaccuccgggacguacggcaccgggagcuggccggacggcgccgacaucaaccugaugcccaucuga

SEQ ID NO: 24556 - RNA, 1410 nt, Artificial Sequence; identical to SEQ ID NO: 19001
  derived and/or modified CDS sequence (AUadapt) from InfluenzaA__AFH74535__NA

SEQ ID NO: 24557 - RNA, 1410 nt, Artificial Sequence; identical to SEQ ID NO: 24037
  derived and/or modified CDS sequence (AUadapt) from InfluenzaA__AFH74546__NA

SEQ ID NO: 24558 - RNA, 1410 nt, Artificial Sequence; identical to SEQ ID NO: 24037
  derived and/or modified CDS sequence (AUadapt) from InfluenzaA__AFH74557__NA

SEQ ID NO: 24559 - RNA, 1410 nt, Artificial Sequence; identical to SEQ ID NO: 24037
  derived and/or modified CDS sequence (AUadapt) from InfluenzaA__AFH74568__NA

SEQ ID NO: 24560 - RNA, 1410 nt, Artificial Sequence; identical to SEQ ID NO: 24040
  derived and/or modified CDS sequence (AUadapt) from InfluenzaA__AFH74579__NA

SEQ ID NO: 24561 - RNA, 1410 nt, Artificial Sequence
  derived and/or modified CDS sequence (AUadapt) from InfluenzaA__AFH74590__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugauguccguguga

SEQ ID NO: 24562 - RNA, 1410 nt, Artificial Sequence; identical to SEQ ID NO: 24037
  derived and/or modified CDS sequence (AUadapt) from InfluenzaA__AFH74601__NA

SEQ ID NO: 24563 - RNA, 1410 nt, Artificial Sequence
  derived and/or modified CDS sequence (AUadapt) from InfluenzaA__AFH74612__NA
augaaccccaaccagaagaucaucaccaucggcucggugucccugaccaucagcacgaucugcuucuucaugcagaccgccauccucaucaccaccgucacgcugcacuucaagcagugcgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggacgacccuguccaacgugcacagcaacaacaccguccgcgaccggaccccguaccgcacgcugcucaugaacgagcugggcgugcccuuccaccugggcaccaagcaggucugcaucgccugguccucguccagcugccacgacgggaaggccuggcuccacgugugcaucaccggcgacgacaagaacgcgaccgccuccuucaucuacaacgggcggcugguggacucgguggucuccuggagcaaggagauccugcgcacgcaggaguccgagugcgugugcaucaacgggaccugcaccguggucaugaccgacgggucggccagcggcaaggccgacacgaagauccucuucaucgaggagggcaagaucgugcacaccuccacccugucgggguccgcgcagcacguggaggagugcagcugcuacccccgguaccccggcguccgcugcgugugccgggacaacuggaagggguccaaccgcccgaucguggacaucaacaucaaggaccacucgaucgucuccagcuacgugugcuccggccuggugggcgacacgccccggaagaacgacucguccagcuccucgcacugccucgaccccaacaacgaggagggcggccacggggucaagggcugggccuucgacgacgggaacgacguguggaugggccgcaccaucuccgagaagucccggcugggcuacgagaccuucaaggucaucgagggguggagcaaccccaagucgaagcugcagaucaaccgccaggugaucguggaccggggcaaccgcuccggguacagcggcaucuucucggucgaggggaaguccugcaucaaccggugcuucuacguggagcucauccgcggccggaaggaggagaccgaggugcuguggaccagcaacuccaucgucguguucugcggcacgagcgggaccuacggcaccggguccuggccggacggcgccgacaucaaccugaugcccaucuga

SEQ ID NO: 24564 - RNA, 1410 nt, Artificial Sequence; identical to SEQ ID NO: 24037
  derived and/or modified CDS sequence (AUadapt) from InfluenzaA__AFH74623__NA

SEQ ID NO: 24565 - RNA, 1410 nt, Artificial Sequence; identical to SEQ ID NO: 24037
  derived and/or modified CDS sequence (AUadapt) from InfluenzaA__AFH74634__NA

SEQ ID NO: 24566 - RNA, 1410 nt, Artificial Sequence; identical to SEQ ID NO: 24044
  derived and/or modified CDS sequence (AUadapt) from InfluenzaA__AFH74645__NA

SEQ ID NO: 24567 - RNA, 1410 nt, Artificial Sequence; identical to SEQ ID NO: 24044
  derived and/or modified CDS sequence (AUadapt) from InfluenzaA__AFH74656__NA

SEQ ID NO: 24568 - RNA, 1410 nt, Artificial Sequence; identical to SEQ ID NO: 24044
  derived and/or modified CDS sequence (AUadapt) from InfluenzaA__AFH74667__NA

SEQ ID NO: 24569 - RNA, 1410 nt, Artificial Sequence; identical to SEQ ID NO: 24044
  derived and/or modified CDS sequence (AUadapt) from InfluenzaA__AFH74678__NA

SEQ ID NO: 24570 - RNA, 1410 nt, Artificial Sequence; identical to SEQ ID NO: 19001
  derived and/or modified CDS sequence (AUadapt) from InfluenzaA__AFH74689__NA

SEQ ID NO: 24571 - RNA, 1410 nt, Artificial Sequence; identical to SEQ ID NO: 19001
  derived and/or modified CDS sequence (AUadapt) from InfluenzaA__AFH74700__NA

SEQ ID NO: 24572 - RNA, 1410 nt, Artificial Sequence
  derived and/or modified CDS sequence (AUadapt) from InfluenzaA__AFH74711__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccugcguccgcugcgugugccgggacaacuggaagggcucgaaccgcccgaucguggacaucaacaucaaggaccacuccaucgucagcuccuacgugugcucggggcuggugggcgacacgccccggaagaacgacuccagcuccagcucccacugccucgaccccaacaacgaggagggcgggcacggcgucaaggggugggccuucgacgacggcaacgacguguggauggggcgcaccaucucggagaagucccggcugggcuacgagaccuucaaggucaucgagggcuggagcaaccccaaguccaagcugcagaucaaccgccaggugaucguggaccgggggaaccgcucgggcuacuccgggaucuucagcgucgagggcaagucgugcaucaaccggugcuucuacguggagcucauccgcgggcggaaggaggagaccgaggugcuguggaccuccaacagcaucgucguguucugcggcaccuccggcacguacgggaccggcagcuggccggacggggccgacaucaaccugaugcccguguga

SEQ ID NO: 24573 - RNA, 1410 nt, Artificial Sequence; identical to SEQ ID NO: 24037
  derived and/or modified CDS sequence (AUadapt) from InfluenzaA__AFH74722__NA

SEQ ID NO: 24574 - RNA, 1410 nt, Artificial Sequence; identical to SEQ ID NO: 24037
  derived and/or modified CDS sequence (AUadapt) from InfluenzaA__AFH74733__NA

SEQ ID NO: 24575 - RNA, 1410 nt, Artificial Sequence
  derived and/or modified CDS sequence (AUadapt) from InfluenzaA__AFH74744__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucgaacuacgugugcuccggccuggugggcgacacgccccggaagaacgacagcuccucguccagccacugccucgaccccaacaacgaggagggcgggcacggggucaagggcugggccuucgacgacgggaacgacguguggaugggccgcaccaucuccgagaagucccggcugggcuacgagaccuucaaggucaucgagggguggucgaaccccaagagcaagcugcagaucaaccgccaggugaucguggaccggggcaaccgcuccggguacucgggcaucuucuccgucgagggcaagagcugcaucaaccggugcuucuacguggagcucauccgcgggcggaaggaggagaccgaggugcuguggaccucgaacuccaucgucguguucugcggcaccagcgggacguacggcaccggguccuggccggacggcgccgacaucaaccugaugcccguguga

SEQ ID NO: 24576 - RNA, 1410 nt, Artificial Sequence; identical to SEQ ID NO: 24037
  derived and/or modified CDS sequence (AUadapt) from InfluenzaA__AFH74755__NA

SEQ ID NO: 24577 - RNA, 1410 nt, Artificial Sequence; identical to SEQ ID NO: 24037
  derived and/or modified CDS sequence (AUadapt) from InfluenzaA__AFH74766__NA

SEQ ID NO: 24578 - RNA, 1410 nt, Artificial Sequence; identical to SEQ ID NO: 24037
  derived and/or modified CDS sequence (AUadapt) from InfluenzaA__AFH74777__NA

SEQ ID NO: 24579 - RNA, 1410 nt, Artificial Sequence; identical to SEQ ID NO: 19001
  derived and/or modified CDS sequence (AUadapt) from InfluenzaA__AFH74788__NA

SEQ ID NO: 24580 - RNA, 1410 nt, Artificial Sequence
  derived and/or modified CDS sequence (AUadapt) from InfluenzaA__AFH74799__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcggccccgacaagugcuaccaguucgcccucgggcagggcaccacgcugaacaacgugcacuccaacaacaccguccgcgaccggaccccguaccgcacccugcucaugaacgagcugggcgugcccuuccaccuggggacgaagcaggucugcaucgccuggagcuccucguccugccacgacggcaaggccuggcuccacgugugcaucaccggggacgacaagaacgcgaccgccagcuucaucuacaacggccggcugguggacuccguggucucgugguccaaggagauccugcgcacccaggagagcgagugcgugugcaucaacgggacgugcaccguggucaugaccgacggcuccgccucgggcaaggccgacaccaagauccucuucaucgaggaggggaagaucgugcacacgagcacccuguccggcucggcgcagcacguggaggagugcuccugcuacccccgguaccccgggguccgcugcgugugccgggacaacuggaagggcagcaaccgcccgaucguggacaucaacaucaaggaccacuccaucgucucguccuacgugugcagcggccuggugggggacacgccccggaagaacgacuccucguccagcucccacugccucgaccccaacaacgaggagggcgggcacggcgucaaggggugggccuucgacgacggcaacgacguguggaugggccgcaccaucucggagaagucccggcugggguacgagaccuucaaggucaucgagggcuggagcaaccccaaguccaagcugcagaucaaccgccaggugaucguggaccgggggaaccgcucgggcuacuccgggaucuucagcgucgagggcaagucgugcaucaaccggugcuucuacguggagcucauccgcggccggaaggaggagaccgaggugcuguggaccuccaacagcaucgucguguucugcgggaccuccggcacguacgggaccggcagcuggccggacggggccgacaucaaccugaugcccguguga

SEQ ID NO: 24581 - RNA, 1410 nt, Artificial Sequence; identical to SEQ ID NO: 24057
  derived and/or modified CDS sequence (AUadapt) from InfluenzaA__AFH74810__NA

SEQ ID NO: 24582 - RNA, 1410 nt, Artificial Sequence; identical to SEQ ID NO: 24057
  derived and/or modified CDS sequence (AUadapt) from InfluenzaA__AFH74821__NA

SEQ ID NO: 24583 - RNA, 1410 nt, Artificial Sequence; identical to SEQ ID NO: 24057
  derived and/or modified CDS sequence (AUadapt) from InfluenzaA__AFH74832__NA

SEQ ID NO: 24584 - RNA, 1410 nt, Artificial Sequence; identical to SEQ ID NO: 24057
  derived and/or modified CDS sequence (AUadapt) from InfluenzaA__AFH74843__NA

SEQ ID NO: 24585 - RNA, 1410 nt, Artificial Sequence; identical to SEQ ID NO: 24037
  derived and/or modified CDS sequence (AUadapt) from InfluenzaA__AFH74854__NA

SEQ ID NO: 24586 - RNA, 1410 nt, Artificial Sequence; identical to SEQ ID NO: 24037
  derived and/or modified CDS sequence (AUadapt) from InfluenzaA__AFH74865__NA

SEQ ID NO: 24587 - RNA, 1410 nt, Artificial Sequence; identical to SEQ ID NO: 24037
  derived and/or modified CDS sequence (AUadapt) from InfluenzaA__AFH74876__NA

SEQ ID NO: 24588 - RNA, 1410 nt, Artificial Sequence; identical to SEQ ID NO: 24037
  derived and/or modified CDS sequence (AUadapt) from InfluenzaA__AFH74887__NA

SEQ ID NO: 24589 - RNA, 1410 nt, Artificial Sequence; identical to SEQ ID NO: 24037
  derived and/or modified CDS sequence (AUadapt) from InfluenzaA__AFH74898__NA

SEQ ID NO: 24590 - RNA, 1410 nt, Artificial Sequence; identical to SEQ ID NO: 24037
  derived and/or modified CDS sequence (AUadapt) from InfluenzaA__AFH74909__NA

SEQ ID NO: 24591 - RNA, 1410 nt, Artificial Sequence
  derived and/or modified CDS sequence (AUadapt) from InfluenzaA__AFH74920__NA
augaaccccaaccagaagaucaucaccaucggcucggugucccugaccaucucgacgaucugcuucuucaugcagaccgccauccucaucaccaccgucacgcugcacuucaagcagugcgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacgcaggagucggagugcgugugcaucaacgggaccugcaccguggucaugaccgacggcuccgccagcggcaaggccgacacgaagauccucuucaucgaggagggcaagaucgugcacaccucgacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccucgucccacugccucgaccccaacaacgaggagggggaccacggcgucaaggggugggccuucgacgacggcaacgacguguggauggggcgcaccaucagcgagaagucccggcugggcuacgagaccuucaaggucaucgagggcuggucgaaccccaaguccaagcugcagaucaaccgccaggugaucguggaccgggggaaccgcagcggcuacuccgggaucuucucggucgagggcaagagcugcaucaaccggugcuucuacguggagcucauccgcgggcggaaggaggagaccgaggugcuguggaccuccaacucgaucgucguguucugcggcacguccggcaccuacgggaccggcagcuggccggacggggccgacaucaaccugaugcccaucuga

SEQ ID NO: 24592 - RNA, 1410 nt, Artificial Sequence; identical to SEQ ID NO: 19001
  derived and/or modified CDS sequence (AUadapt) from InfluenzaA__AFH74931__NA

SEQ ID NO: 24593 - RNA, 1410 nt, Artificial Sequence; identical to SEQ ID NO: 19001
  derived and/or modified CDS sequence (AUadapt) from InfluenzaA__AFH74942__NA

SEQ ID NO: 24594 - RNA, 1410 nt, Artificial Sequence; identical to SEQ ID NO: 24037
  derived and/or modified CDS sequence (AUadapt) from InfluenzaA__AFH74953__NA

SEQ ID NO: 24595 - RNA, 1410 nt, Artificial Sequence
  derived and/or modified CDS sequence (AUadapt) from InfluenzaA__AFH74964__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgauccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggaccuacggcacggggagcuggccggacggcgccgacaucaaccugaugcccguguga

SEQ ID NO: 24596 - RNA, 1410 nt, Artificial Sequence; identical to SEQ ID NO: 24037
  derived and/or modified CDS sequence (AUadapt) from InfluenzaA__AFH75391__NA

SEQ ID NO: 24597 - RNA, 1410 nt, Artificial Sequence; identical to SEQ ID NO: 16318
  derived and/or modified CDS sequence (AUadapt) from InfluenzaA__AFH97143__NA

SEQ ID NO: 24598 - RNA, 1410 nt, Artificial Sequence
  derived and/or modified CDS sequence (AUadapt) from InfluenzaA__AFI56407__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaaggggaacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcucgugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacagcuucuccaucaagcaggacaucgucgggaucaacgaguggucgggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgggaccgugggcuggagcuggcccgacggcgccgagcugccguucacgaucgacaaguga

SEQ ID NO: 24599 - RNA, 1410 nt, Artificial Sequence
  derived and/or modified CDS sequence (AUadapt) from InfluenzaA__AFJ05141__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcucgcugcugaugaacgagcucggcgugcccuuccaccugggcaccaagcaggucugcaucgccugguccagcuccucgugccacgacgggaaggccuggcugcacgugugcaucacgggcgacgacaagaacgcgaccgccuccuucaucuacaacgggcggcucguggacagcguggucuccuggucgaaggagauccugcgcacccaggaguccgagugcgugugcaucaacgggaccugcacgguggucaugaccgacgggagcgccucgggcaaggccgacaccaagauccuguucaucgaggagggcaagaucgugcacaccuccacgcucagcggguccgcgcagcacguggaggagugcucgugcuacccccgguacccgggcguccgcugcgugugccgggacaacuggaagggguccaaccgccccaucguggacaucaacaucaaggaccacagcaucgucuccucguacgugugcuccggccuggugggcgacacgccccggaagaacgacagcuccucguccagccacugccuggaccccaacaacgaggagggcggccacggggucaagggcugggccuucgacgacgggaacgacguguggaugggccgcaccaucaacgagaccucccggcucggcuacgagaccuucaaggucaucgagggguggucgaacccgaaguccaagcugcagaucaaccgccaggugaucguggaccggggcgaccgcagcggguacuccggcaucuucucggucgagggcaagagcugcaucaaccggugcuucuacguggagcugauccgcgggcggaaggaggagaccgaggugcucuggaccuccaacucgaucgucguguucugcggcaccuccgggacguacggcaccgggagcuggcccgacggcgccgaccugaaccugaugcccaucuga

SEQ ID NO: 24600 - RNA, 1410 nt, Artificial Sequence
  derived and/or modified CDS sequence (AUadapt) from InfluenzaA__AFJ05145__NA
augaaccccaaccagaagaucaucaccaucggcucggugucccugaccaugucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcgggcacggggucaagggcugggccuucgacgacgggaacgacguguggaugggccgcaccaucaacgagacgucgcggcucggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcccaucuga

SEQ ID NO: 24601 - RNA, 1410 nt, Artificial Sequence
  derived and/or modified CDS sequence (AUadapt) from InfluenzaA__AFJ05635__NA
augaaccccaaccagaagaucaucaccaucggcucggugugcaugaccaucgggauggccaaccugauccuccagaucggcaacaucaucuccaucuggaucagccacuccauccagcugcgcaaccagagccagaucgagacgugcaaccaguccgucaucaccuacgagaacaacaccugggugaaccagaccuacgugaacaucagcaacacgaacuucgccgcggggcaguccgucgugucgaugaagcuggccggcaacuccagccucugcccgguguccgggugggccaucuacagcaaggacaacuccauccggaucggcagcaagggcgacgucuucgugauccgcgagcccuucaucuccugcagcccccuggagugccggaccuucuuccugacccagggggcccuccugaacgacaagcacuccaacggcaccaucaaggaccgcucgcccuaccggacgcugauguccugcccgaucggggaggugcccagccccuacaacagccgcuucgaguccgucgccuggagcgcguccgccugccacgacggcaucaacuggcucaccaucgggaucagcggccccgacaacggcgccguggccgugcugaaguacaacgggaucaucaccgacaccaucaaguccuggcggaacaacauccugcgcacgcaggagucggagugcgcgugcgucaacggcuccugcuucaccaucaugaccgacgggccgagcgacggccaggccuccuacaagaucuuccggaucgagaagggcaagaucgucaagagcguggagaugaacgcccccaacuaccacuacgaggagugcuccugcuaccccgacagcuccgagaucacgugcgugugccgcgacaacuggcacgggagcaaccggcccuggguguccuucaaccagaaccucgaguaccagaucggcuacaucugcucggggaucuucggcgacaacccgcgccccaacgacaagaccggguccugcggccccgugagcuccaacggcgccaacggggucaagggcuucagcuucaaguacgggaacggcguguggaucgggcggaccaagagcaucuccagccgcaagggcuucgagaugaucugggaccccaacggcuggaccgggaccgacaacaacuucuccaucaagcaggacaucgugggcaucaacgaguggucgggguacuccggcagcuucguccagcacccggagcugacggggcuggacugcauccggcccugcuucuggguggagcucauccgcggccggcccaaggagaacaccaucuggaccuccggcagcuccaucagcuucugcggggugaacuccgacaccgucggcuggagcuggcccgacggggccgagcugccguucacgaucgacaaguga

SEQ ID NO: 24602 - RNA, 1410 nt, Artificial Sequence
  derived and/or modified CDS sequence (AUadapt) from InfluenzaA__AFJ11709__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccucgucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagucgaagcugcagaucaaccgccaggugaucguggaccggggcaaccgcuccggguacagcggcaucuucuccgucgagggcaagucgugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcugaucuga

SEQ ID NO: 24603 - RNA, 1410 nt, Artificial Sequence
  derived and/or modified CDS sequence (AUadapt) from InfluenzaA__AFJ11720__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugaucgacuccguggugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucaacgagaccucgcggcugggcuacgagaccuucaaggugaucgaggggugguccaaccccaagagcaagcugcagaucaaccgccaggucaucguggacaagggcaaccgguccggguacucgggcaucuucuccguggagggcaagagcugcaucaaccgcugcuucuacgucgagcucauccgggggcgcaaggaggagaccgaggugcuguggaccucgaacuccaucguggucuucugcggcacgagcgggaccuacggcaccggguccuggccggacggcgccgaccugaaccucaugcccaucuga

SEQ ID NO: 24604 - RNA, 1410 nt, Artificial Sequence; identical to SEQ ID NO: 23545
  derived and/or modified CDS sequence (AUadapt) from InfluenzaA__AFJ11731__NA

SEQ ID NO: 24605 - RNA, 1410 nt, Artificial Sequence
  derived and/or modified CDS sequence (AUadapt) from InfluenzaA__AFJ19845__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccgacguccgcugcgugugccgggacaacuggaagggcagcaaccgcccgaucguggacaucaacaucaaggaccacuccaucgucucguccuacgugugcagcgggcuggugggcgacacgccccggaagaacgacuccucguccagcucccacugccucgaccccaacaacgaggagggcgggcacggcgucaaggggugggccuucgacgacggcaacgacguguggauggggcgcaccaucaacgagaccucgcggcugggcuacgagaccuucaaggucaucgagggcugguccaaccccaagagcaagcugcagaucaaccgccaggugaucguggacaaggggaaccgguccggcuacucggggaucuucuccgucgagggcaagagcugcaucaaccgcugcuucuacguggagcucauccgggggcgcaaggaggagaccgaggugcuguggaccucgaacuccaucgucguguucugcggcacgagcggcaccuacgggaccggcuccuggccggacggggccgaccugaaccucaugcccaucuga

SEQ ID NO: 24606 - RNA, 1410 nt, Artificial Sequence; identical to SEQ ID NO: 16318
  derived and/or modified CDS sequence (AUadapt) from InfluenzaA__AFJ44697__NA

SEQ ID NO: 24607 - RNA, 1410 nt, Artificial Sequence; identical to SEQ ID NO: 22659
  derived and/or modified CDS sequence (AUadapt) from InfluenzaA__AFJ69989__NA

SEQ ID NO: 24608 - RNA, 1410 nt, Artificial Sequence
  derived and/or modified CDS sequence (AUadapt) from InfluenzaA__AFJ69990__NA
augaaccccaaccagaagaucaucaccaucggcucggugugcaugaccaucgggauggccaaccugauccuccagaucggcaacaucacguccaucuggaucagccacuccauccagcuggggaaccagaaccagaucgagaccugcaaccagagcgucaucaccuacgagaacaacaccugggugaaccagacguacgugaacaucuccaacaccaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccggaucggguacaucugcuccggcaucuucggggacaacccgcgccccaacgacaagaccggcagcugcggccccguguccucgaacggggccaacggcgugaagggguucuccuucaaguacggcaacggggucuggaucggccggaccaagagcaucagcucccgcaacggcuucgagaugaucugggaccccaacggguggaccggcacggacaacaacuucagcaucaagcaggacaucaucgggaucaacgagugguccggcuacucgggguccuucgugcagcacccggagcugaccggccuggacugcauccggcccugcuucuggguggagcucauccgcggccggcccaaggagaacaccaucuggaccagcggguccagcaucuccuucugcggcgucaacagcgacacgguggggugguccuggcccgacggcgccgagcugccguucaccaucgacaaguga

SEQ ID NO: 24609 - RNA, 1410 nt, Artificial Sequence
  derived and/or modified CDS sequence (AUadapt) from InfluenzaA__AFJ69991__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucucgaacacgaacuucgccgcgggccaguccgucgugagcgugaagcuggccgggaacuccagccucugcccggucuccggcugggccaucuacagcaaggacaacuccauccgcaucggcucgaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccucgcccuacaaccaggaccucagccacuccgccuggagcgcguccgccugccacgacgggaucaacuggcugaccaucggcaucagcggccccgacaacggggccguggccgugcugaaguacaacggcaucaucaccgacaccaucaaguccuggcggaacaacauccuccgcacgcaggagucggagugcgcgugcgucaacggguccugcuucaccaucaugaccgacggcccgagcgacggccaggccuccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcucgaaccggcccuggguguccuucaaccagaaccuggaguaccagaucggguacaucugcagcggcaucuucggggacaacccgcgccccaacgacaagaccggcuccugcggccccgugagcuccaacggggccaacggcgucaagggguucucguucaaguacggcaacgggguguggaucggccggaccaagagcaucuccagccgcaagggcuucgagaugaucugggaccccaacggguggaccggcaccgacaacaacuucuccaucaagcaggacaucguggggaucaacgaguggagcggcuacuccgggucguucguccagcacccggagcugacgggccucgacugcauccggcccugcuucuggguggagcugauccgcggccggcccaaggagaacaccaucuggaccuccgggagcuccaucagcuucugcggcgugaacuccgacaccgucggguggagcuggcccgacggcgccgagcugccguucacgaucgacaaguga

SEQ ID NO: 24610 - RNA, 1410 nt, Artificial Sequence; identical to SEQ ID NO: 19966
  derived and/or modified CDS sequence (AUadapt) from InfluenzaA__AFJ69992__NA

SEQ ID NO: 24611 - RNA, 1410 nt, Artificial Sequence
  derived and/or modified CDS sequence (AUadapt) from InfluenzaA__AFJ69993__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucgugggccgggggaaccgcuccggcuacucggggaucuucuccgucgagggcaagagcugcaucaaccggugcuucuacguggagcucauccgcggccggaaggaggagaccgaggugcuguggaccucgaacuccaucgucguguucugcgggacgagcggcaccuacgggaccggcuccuggccggacggggccaaccugaaccucaugcccaucuga

SEQ ID NO: 24612 - RNA, 1410 nt, Artificial Sequence; identical to SEQ ID NO: 21920
  derived and/or modified CDS sequence (AUadapt) from InfluenzaA__AFJ69994__NA

SEQ ID NO: 24613 - RNA, 1413 nt, Artificial Sequence
  derived and/or modified CDS sequence (AUadapt) from InfluenzaA__AFJ74389__NA
augaaccccaaccagaagaucaucaccaucggcucgaucuccaucgccaucgggaucaucucgcugauccuccagaucggcaacaucaucuccaucugggccagccacuccauccagaccgggucgcagaaccacacgggcgugugcaaccagcgcaucaucaccuacgagaacuccaccugggucaaccagaccuacgugaacaucaacaacacgaacguggucgcggggaaggacaagaccagcaugacccuggccggcaacuccucgcugugcccgauccggggcugggccaucuacaccaaggacaacuccauccgcaucgggagcaagggcgacguguucgugauccgggagcccuucaucuccugcucgcaccucgagugccgcacguucuuccugacccagggggcccugcucaacgacaagcacuccaacggcaccgucaaggaccggagccccuaccgcgcccugauguccugcccccugggggaggcgccgucgcccuacaacucccgguucgagagcguggccuggucggccuccgccugccacgacggccucggcuggcugaccaucgggaucagcggccccgacaacggggcgguggccguccugaaguacaacggcaucaucacggagaccaucaaguccuggaagaagcgcauccuccggacccaggagucggagugcgugugcaugaacggcuccugcuucaccaucaugacggacgggcccagcaacggcgccgccuccuaccgcaucuucaagaucgagaaggggcgggugaccaagucgaucgagcuggacgccccgaacuaccacuacgaggagugcuccugcuaccccgacaccggcaccgucaugugcgugugccgcgacaacuggcacgggagcaaccggcccuggguguccuucaaccagaaccuggacuaccagaucggcuacaucugcucgggcgucuucggggacaacccccgcccgaaggacggcgagggguccugcaaccccgugacgguggacggcgcggacggggucaagggcuucagcuaccgguacggcaacgggguguggaucggccgcaccaaguccaaccggcuccgcaagggguucgagaugaucugggaccccaacggcuggaccgacaccgacucggacuucuccaugaagcaggacaucguggccaugacggacuggagcggguacuccggcucguucguccagcaccccgagcugaccggccuggacugcaugcggccgugcuucuggguggagcucgugcgcgggcugccccgggagaacaccaccaucuggacgagcggcuccucgaucuccuucugcggggucaacagcgacaccgccaacugguccuggcccgacggcgccgagcugcccuucaccaucgacaaguga

SEQ ID NO: 24614 - RNA, 1410 nt, Artificial Sequence
  derived and/or modified CDS sequence (AUadapt) from InfluenzaA__AFJ74399__NA
augaaccccaaccagaagaucaucaccaucggcucggugucccugaccaucgccacgaucugcuuccucaugcagaucgccauccuggucaucacccugacccuccacuucaagcaguacgagugcaacagcccgcccaacaaccaggugaugcugugcgagcccaccaucaucgagcgcaacaucacggagaucguguaccugaccaacaccaccaucgagaaggagaucugccccaagcucgcggaguaccggaacugguccaagccgcagugcaagaucacgggguucgcccccuucucgaaggacaacuccauccgccugagcgccggcggggacaucugggucacccgggagcccuacguguccugcgaccccggcaagugcuaccaguucgcccuggggcagggcaccacccucaacaaccgccacucgaacgacacggugcacgaccggaccccguaccgcacccugcugaugaacgagcucggcguccccuuccaccuggggaccaagcaggucugcaucgccugguccagcuccucgugccacgacggcaaggcguggcugcacgugugcgugacggggcacaacgagaacgccaccgccuccuucaucuacgacggccggcucguggacagcaucggguccuggucgaagaacauccugcgcacccaggaguccgagugcgugugcaucaacgggaccugcacggucgugaugaccgacggcagcgccuccgggcgggcggacaccaagauccuguucaucgaggagggcaagaucgugcacaucucgccccucagcggguccgcccagcacgucgaggagugcucgugcuacccccgcuacccgggcgugcggugcgugugccgcgacaacuggaagggcuccaaccggcccaucgucgacaucaacgugaaggacuucagcaucguguccucguacgucugcuccgggcuggugggcgacacgccccgcaagaacgacagcuccucguccagccacugccugaaccccaacaacgaggagggcggccacggggugaagggcugggccuucgacgacggcaacgacgucuggauggggcggaccaucuccgagaagcuccgcucgggcuacgagaccuucaaggugaucgggggcugguccaagccgaacagcaagcugcagaucaaccggcaggucaucguggaccgcgggaaccgguccggcuacucgggcaucuucuccguggagggcaagagcugcaucaaccgcugcuucuacgucgagcugauccgggggcgcaagcaggagaccgaggugugguggaccucgaacuccaucguggucuucugcgggacgagcggcaccuacgggaccggcuccuggcccgacggcgccgacaucaaccucaugcccaucuga

SEQ ID NO: 24615 - RNA, 1410 nt, Artificial Sequence
  derived and/or modified CDS sequence (AUadapt) from InfluenzaA__AFJ74410__NA
augaaccccaaccagaagaucaucaccaucggcucggugucccugaccaucgccacgaucugcuuccucaugcagaucgccauccuggucaugaccgugacccugcacuucaagcaguacgagugcaacucgccgcccaacaaccaggugaugcucugcgagcccaccaucaucgagcgcaacaucacggagaucgucuaccugaccaacaccaccaucgagaaggagaucugccccaagcuggcggaguaccggaacugguccaagccgcagugcaagaucacgggguucgcccccuucagcaaggacaacuccauccgccucucggccggcggggacaucugggugacccgggagcccuacguguccugcgaccccggcaagugcuaccaguucgcccuggggcagggcaccacccugaacaaccgccacagcaacgacacgguccacgaccggaccccguaccgcacccuccugaugaacgagcugggcgugcccuuccaccucgggaccaagcaggucugcaucgccugguccucguccagcugccacgacggcaaggcguggcugcacgugugcgugacggggcacaacgagaacgccaccgccuccuucaucuacgacggccggcugguggacucgaucggguccuggagcaagaacauccuccgcacccaggaguccgagugcgucugcaucaacgggaccugcacgguggugaugaccgacggcucggccuccgggcgggcggacaccaagauccuguucaucgaggagggcaagaucguccacaucagcccccugucgggguccgcccagcacguggaggagugcucgugcuacccccgcuacccgggcgugcggugcgucugccgcgacaacuggaagggcuccaaccggcccaucguggacaucaacgugaaggacuacagcaucaucuccucguacgucugcuccgggcucgugggcgacacgccccgcaagaacgacagcuccucguccagccacugccugaaccccaacaacgaggagggcggccacggggugaagggcugggccuucgacgacggcaacgacgucuggauggggcggaccaucuccgagaagcugcgcucgggcuacgagaccuucaaggugaucgggggcugguccaagccgaacagcaagcuccagaucaaccggcaggucaucguggaccgcgggaaccgguccggcuacucgggcaucuucuccguggagggcaagagcugcaucaaccgcugcuucuacgucgagcugauccgggggcgcaagcaggagaccgaggugugguggaccucgaacuccaucguggucuucugcgggacgagcggcaccuacgggaccggcuccuggcccgacggcgccgacaucaaccugaugcccaucuga

SEQ ID NO: 24616 - RNA, 1410 nt, Artificial Sequence; identical to SEQ ID NO: 16717
  derived and/or modified CDS sequence (AUadapt) from InfluenzaA__AFJ74451__NA

SEQ ID NO: 24617 - RNA, 1413 nt, Artificial Sequence
  derived and/or modified CDS sequence (AUadapt) from InfluenzaA__AFJ74462__NA
augaaccccaaccagaagaucaucaccaucggcucgaucuccguggccaucgggaucaucagccugauccuccagaucggcaacaucaucuccaucugggccucgcacuccauccagaccgggagccagaacuacacgggcaucugcaaccagcgcaucaucaccuacgagaacuccaccugggucaaccagaccuacgugaacaucaacaacacgaacguggucgcggggaaggacaagaccucgaugacccuggccggcaacuccagccugugcccgauccggggcugggccaucuacaccaaggacaacuccauccgcaucgggucgaagggcgacguguucgugauccgggagcccuucaucuccugcagccaccucgagugccgcacguucuuccugacccagggggcccugcucaacgacaagcacuccaacggcaccgucaaggaccggucgcccuaccgcgcccugauguccugcccccugggggaggcgccgagccccuacaacucccgguucgagucgguggccuggagcgccuccgccugccacgacggccucggcuggcugaccaucgggaucucgggccccgacaacggggcgguggccguccugaaguacaacggcaucaucacggagaccaucaaguccuggaagaagcagauccuccgcacccaggagagcgagugcgugugcgugaacggcuccugcuucaccaucaugacggacgggcccucgaaccgggccgccuccuaccgcaucuucaagaucgagaagggccgggucaccaagagcaucgagcuggacgccccgaacuaccacuacgaggagugcuccugcuaccccgacaccgggaccgugaugugcgugugccgcgacaacuggcacggcucgaaccggcccugggucuccuucaaccagaaccuggacuaccagaucggguacaucugcagcggcguguucggcgacaacccccgcccgaaggacggggagggcuccugcaaccccgugacggucgacggggcggacggcgugaagggguucucguaccgguacggcaacggcguguggaucgggcgcaccaaguccaaccggcuccgcaagggcuucgagaugaucugggaccccaacggguggaccgacaccgacagcgacuucuccaugaagcaggacgucguggccaugacggacuggucgggcuacuccgggagcuucgugcagcaccccgagcugaccggccuggacugcaugcggccgugcuucugggucgagcucgugcgcggccugccccgggagaacaccaccaucuggacgucgggguccagcaucuccuucugcggcgucaacagcgagaccgccaacugguccuggcccgacggggccgagcugcccuucaccaucgacaaguga

SEQ ID NO: 24618 - RNA, 1410 nt, Artificial Sequence
  derived and/or modified CDS sequence (AUadapt) from InfluenzaA__AFJ74517__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuacaugaccaacaccacgaucgagaaggagaucugccccaagcuggcggaguaccggaacugguccaagccgcagugcaagaucaccggguucgcccccuucagcaaggacaacuccauccgccugucggccggcggggacaucugggugacccgggagcccuacguguccugcgaccccgacaagugcuaccaguucgcccucggccaggggaccacgcugaacaaccgccacagcaacgacaccguccacgaccggaccccguaccgcacccugcucaugaacgagcugggcgugcccuuccaccugggcacgaagcaggucugcaucgccugguccucguccucgugccacgacgggaaggcguggcuccacgugugcgugaccggccacgacgagaacgccaccgccuccuucaucuacgacgggcggcugguggacagcaucggcuccuggucgaagaagauccugcgcacccaggaguccgagugcgucugcaucaacgggacgugcaccguggugaugaccgacggcagcgccuccggccgggcggacaccaagauccucuucaucgaggaggggaagaucguccacaucucgcagcugagcggcuccgcccagcacguggaggagugcucgugcuacccccgcuaccccggggugcggugcgucugccgcgacaacuggaagggcuccaaccggccgaucguggacaucaacgugaaggacuacucgaucgucuccagcuacgugugcuccggccuggugggggacacgccccgcaagaacgacucguccagcuccucgcacugccucaaccccaacaacgaggagggcgggcacggcgucaaggggugggccuucgacgacggcaacgacguguggaugggccggaccaucuccgagaagcugcgcucgggguacgagaccuucaaggucaucgagggcugguccaagcccaacagcaagcugcagaucaaccgccaggugaucguggaccgggggaaccgguccggcuacucggggaucuucuccgucgagggcaagagcugcaucaaccgcugcuucuacguggagcucauccggggccgcaagcaggagaacgaggugugguggaccucgaacuccaucgucguguucugcgggacgagcggcaccuacgggaccggcuccuggccggacggggccgacaucaaccugaugcccaucuga

SEQ ID NO: 24619 - RNA, 1410 nt, Artificial Sequence
  derived and/or modified CDS sequence (AUadapt) from InfluenzaA__AFJ74564__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaccgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggacgacccugaacaacggccacagcaacgacaccguccacgaccgcaccccguaccggacgcuccugaugaacgagcugggcgugcccuuccaccucgggacccgccaggugugcaucgccugguccucguccucgugccacgacggcaaggcguggcugcacgucugcgugaccggggacgacgagaacgccaccgccuccuucaucuacaacggccggcugguggacagcaucggguccuggucgaagaagauccuccgcacgcaggaguccgagugcgucugcaucaacgggaccugcaccguggugaugaccgacggcagcgccuccgggaaggcggacacgaagauccuguucaucgaggagggcaagaucguccacaucucgacccugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcggccacggggucaagggcugggccuucgacgacggcaacgacguguggauggggcgcaccaucucggagacccugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcacguccgggaccuacggcaccgggagcuggccggacggcgccgacaucaaccugaugcccaucuga

SEQ ID NO: 24620 - RNA, 1413 nt, Artificial Sequence
  derived and/or modified CDS sequence (AUadapt) from InfluenzaA__AFJ74639__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacaacaccugggugaaccacaccuacgucaacaucaacaacacgaacgugguggcggggaaggacaagaccuccgucacccuggccggcaacucgucccugugcagcaucuccggcugggccaucuacaccaaggacaacagcauccggaucggguccaagggcgacguguucgugauccgcgagccguucaucucgugcucccaccucgagugccggacguucuuccugacccagggggcccugcucaacgacaagcacagcaacggcaccgucaaggaccgcucccccuaccgggcccugaugucgugcccccugggggaggcgcccuccccguacaacagcaaguucgagucgguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcaugaacggcucgugcuucaccaucaugacggacgggcccuccaacggcgccgccagcuacaagaucuucaagaucgagaaggggaaggugaccaaguccaucgagcucaacgcccccucguuccacuacgaggagugcuccugcuacccggacaccggcaccgucaugugcgugugccgcgacaacuggcacgggagcaaccggcccuggguguccuucaaccagaaccuggacuaccagaucggcuacaucugcucgggcgucuucggggacaacccccgccccaaggacggcgagggguccugcaacccggugacgguggacggcgcggacggggucaagggcuucagcuacaaguacggcaacgggguguggaucggccggaccaaguccaaccgccugcggaagggguucgagaugaucugggaccccaacggcuggaccaacaccgacagcgacuucuccgugaagcaggacgucguggccaucacggacuggucgggguacagcggcuccuucgugcagcaccccgagcucaccggccuggacugcauccgccccugcuucugggucgagcuggugcgggggcucccgcgcgagaacaccaccaucuggacgucgggcuccagcaucuccuucugcggggucaacagcgacaccgccaacugguccuggcccgacggcgccgagcugcccuucaccaucgacaaguga

SEQ ID NO: 24621 - RNA, 1410 nt, Artificial Sequence
  derived and/or modified CDS sequence (AUadapt) from InfluenzaA__AFJ74640__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccggguaccggaacuggucgaagccgcagugcaacaucaccggcuucgcgcccuucuccaaggacaacagcauccgccuguccgccgggggcgacaucugggucacccgggagcccuacgugucgugcgaccccgacaagugcuaccaguucgcccucgggcagggcaccacgcugaacaacgugcacuccaacgacaccguccacgaccgcaccccguaccggacccugcucaugaacgagcugggcgugcccuuccaccuggggacgaagcaggucugcaucgccuggagcuccucguccugccacgacggcaaggccuggcuccacgugugcgugaccggggacgacgagaacgcgaccgccagcuucaucuacaacggccgccugguggacuccaucgucagcugguccaagaagauccugcggacccaggagucggagugcgugugcaucaacgggacgugcaccguggucaugaccgacggcuccgccagcggcaaggccgacaccaagauccucuucaucgaggaggggaagaucgugcacacgucgacccuguccggcagcgcgcagcacguggaggagugcuccugcuacccccgcuaccccgggguccggugcgugugccgcgacaacuggaagggcucgaaccggccgaucguggacaucaacaucaaggacuacuccaucgucagcuccuacgugugcucgggccuggugggggacacgccccgcaagaacgacuccagcuccagcucccacugccucgaccccaacaacgaggagggcgggcacggcgucaaggggugggccuucgacgacggcaacgacguguggaugggccggaccaucucggagaagcugcgcuccggguacgagaccuucaaggucaucgagggcuggagcaaccccaacuccaagcugcagaucaaccgccaggugaucguggacaaggggaaccggucgggcuacuccgggaucuucagcgucgagggcaagucgugcaucaaccggugcuucuacguggagcucauccgcggccggaagcaggagaccgaggugcuguggaccuccaacagcaucgucguguucugcgggaccuccggcacguacgggaccggcagcuggccggacggggccgacaucaaccugaugcccaucuga

SEQ ID NO: 24622 - RNA, 1413 nt, Artificial Sequence; identical to SEQ ID NO: 24620
  derived and/or modified CDS sequence (AUadapt) from InfluenzaA__AFJ74659__NA

SEQ ID NO: 24623 - RNA, 1413 nt, Artificial Sequence
  derived and/or modified CDS sequence (AUadapt) from InfluenzaA__AFJ74679__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacaacaccugggugaaccacaccuacgucaacaucaacaacacgaacgugguggcggggaaggacaagaccuccgucacccuggccggcaacucgucccugugcagcaucuccggcugggccaucuacaccaaggacaacagcauccggaucggguccaagggcgacguguucgugauccgcgagccguucaucucgugcucccaccucgagugccggacguucuuccugacccagggggcccugcucaacgacaagcacagcaacggcaccgucaaggaccgcucccccuaccgggcccugaugucgugcccccugggggaggcgcccuccccguacaacagcaaguucgagucgguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcaugaacggcucgugcuucaccaucaugacggacgggcccuccaacggcgccgccagcuacaagaucuucaagaucgagaaggggaaggugaccaaguccaucgagcucaacgcccccucguuccacuacgaggagugcuccugcuacccggacaccggcaccgucaugugcgugugccgcgacaacuggcacgggagcaaccggcccuggguguccuucaaccagaaccuggacuaccagaucggcuacaucugcucgggcgucuucggggacaacccccgccccaaggacggcgagggguccugcaacccggugacgguggacggcgcggacggggucaagggcuucagcuacaaguacgacaacggcguguggaucgggcggaccaaguccaaccgccugcggaagggcuucgagaugaucugggaccccaacggguggaccaacaccgacagcgacuucuccgugaagcaggacgucguggccaucacggacuggucgggcuacagcggguccuucgugcagcaccccgagcucaccggccuggacugcauccgccccugcuucugggucgagcuggugcggggccucccgcgcgagaacaccaccaucuggacgucgggguccagcaucuccuucugcggcgucaacagcgacaccgccaacugguccuggcccgacggggccgagcugcccuucaccaucgacaaguga

SEQ ID NO: 24624 - RNA, 1410 nt, Artificial Sequence
  derived and/or modified CDS sequence (AUadapt) from InfluenzaA__AFJ74680__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugauccugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacgagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucaaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaagcaggagaccgaggugcuguggaccuccaacagcaucgucguguucugcggcaccuccgggacguacggcaccgggagcuggccggacggcgccgacaucaaccugaugcccaucuga

SEQ ID NO: 24625 - RNA, 1410 nt, Artificial Sequence
  derived and/or modified CDS sequence (AUadapt) from InfluenzaA__AFJ74701__NA
augaaccccaaccagaagaucaucaccaucggcucggugucccugaccaucgccacgaucugcuuccucaugcagaucgccauccuggucaccaccgugacccugcacuucaaccaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaucugguccaagccgcagugcaacaucaccggguucgcccccuucucgaaggacaacuccauccgccucagcgccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgcgccaggugugcauggccugguccagcuccucgugccacgacggcaaggcguggcugcacgucugcgugaccggggacgacgagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggucgaagcccaacuccaagcuccaggugaaccgccaggugaucgucgagcggggcaaccgcagcggguacuccggcaucuucucgguggagggcaaguccugcaucaaccggugcuucuacguggagcugauccgcgggcggaaggaggagaccgaggucugguggaccagcaacucgaucgugguguucugcggcaccuccgggaccuacggcacggggagcuggccggacggcgccgacaucaaccugaugcccaucuga

SEQ ID NO: 24626 - RNA, 1410 nt, Artificial Sequence
  derived and/or modified CDS sequence (AUadapt) from InfluenzaA__AFJ74731__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacgagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaccgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaccaggagaccgaggugcuguggaccuccaacagcaucgucguguucugcggcacguccgggaccuacggcaccgggagcuggccggacggcgccgagaucaaccugaugcccaucuga

SEQ ID NO: 24627 - RNA, 1413 nt, Artificial Sequence; identical to SEQ ID NO: 24620
  derived and/or modified CDS sequence (AUadapt) from InfluenzaA__AFJ74766__NA

SEQ ID NO: 24628 - RNA, 1410 nt, Artificial Sequence
  derived and/or modified CDS sequence (AUadapt) from InfluenzaA__AFJ74767__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacgagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaccaggagaccgaggugcuguggaccuccaacagcaucgucguguucugcggcaccuccgggacguacggcaccgggagcuggccggacggcgccgacaucaaccugaugcccaucuga

SEQ ID NO: 24629 - RNA, 1410 nt, Artificial Sequence; identical to SEQ ID NO: 24628
  derived and/or modified CDS sequence (AUadapt) from InfluenzaA__AFJ74783__NA

SEQ ID NO: 24630 - RNA, 1410 nt, Artificial Sequence; identical to SEQ ID NO: 16547
  derived and/or modified CDS sequence (AUadapt) from InfluenzaA__AFJ74807__NA

SEQ ID NO: 24631 - RNA, 1410 nt, Artificial Sequence; identical to SEQ ID NO: 16547
  derived and/or modified CDS sequence (AUadapt) from InfluenzaA__AFJ74822__NA

SEQ ID NO: 24632 - RNA, 1410 nt, Artificial Sequence; identical to SEQ ID NO: 17116
  derived and/or modified CDS sequence (AUadapt) from InfluenzaA__AFJ74834__NA

SEQ ID NO: 24633 - RNA, 1410 nt, Artificial Sequence; identical to SEQ ID NO: 16547
  derived and/or modified CDS sequence (AUadapt) from InfluenzaA__AFJ74845__NA

SEQ ID NO: 24634 - RNA, 1413 nt, Artificial Sequence
  derived and/or modified CDS sequence (AUadapt) from InfluenzaA__AFJ75039__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaacaacaccuacgucaacaucaacaacacgucggugguggcggagaaggacaagaccuccgucacccuggccgggaacagcucccugugcagcaucuccggcugggccaucuacaccaaggacaacucgauccggaucggcuccaagggggacguguucgugauccgcgagccguucaucagcugcucccaccucgagugccggacguucuuccugacccagggcgcccugcucaacgacaagcacucgaacgggaccgucaaggaccgcucccccuaccgggcccugaugagcugcccccugggcgaggcgcccagcccguacaacuccaaguucgagucgguggccugguccgccagcgccugccacgacgggaugggcuggcucaccaucggcaucuccgggcccgacaacggcgcgguggccguccugaaguacaacgggaucaucacggagaccaucaagucguggaagaagcgcauccugcggacccaggaguccgagugcgugugcaugaacggcagcugcuucaccaucaugacggacggccccuccaacgggggcgccagcuacaagaucuucaagaucgagaaggggaaggugaccaaguccaucgagcucaacgcccccaacuuccacuacgaggagugcucgugcuacccggacaccggcaccgucaugugcgugugccgcgacaacuggcacggguccaaccggcccugggugagcuucaaccagaaccuggacuaccagaucggcuacaucugcuccggcgucuucggggacaacccccgccccaaggacggcgaggggucgugcaacccggugacgaucgacggcgccgacggggugaagggcuucuccuacaaguacggcaacggggucuggaucggccggaccaagagcaaccgccugcggaagggguucgagaugaucugggaccccaacggcuggaccaacaccgacuccgacuucagcgugaagcaggacguggucgcgaucacggacuggucgggguacuccggcagcuucgugcagcaccccgagcucaccggccuggacugcauccgccccugcuucuggguggagcugguccgggggcucccgcgcgagaacaccaccaucuggacguccggcucguccaucagcuucugcggggugaacuccgacaccgccaacuggagcuggcccgacggcgccgagcugcccuucaccaucgacaaguga

SEQ ID NO: 24635 - RNA, 1410 nt, Artificial Sequence
  derived and/or modified CDS sequence (AUadapt) from InfluenzaA__AFJ75050__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcguccgccuguccgccggcggggacaucugggugacccgggagcccuacgugagcugcgaccccgacaagugcuaccaguucgcccucggccaggggaccacgcugaacaacguccacuccaacgacaccgugcacgaccgcaccccguaccggacccugcucaugaacgagcugggcgugcccuuccaccugggcacgaagcaggucugcaucgccuggucguccagcuccugccacgacgggaaggccuggcuccacgugugcgugaccggcgacgacaagaacgcgaccgccucguucaucuacaacgggcgccuggucgacuccaucgugagcugguccaaggagauccugcggacccaggagagcgagugcgugugcaucaacggcacgugcaccgucgugaugaccgacggguccgccucgggcaaggccgacaccaagauccucuucaucguggagggcaagaucguccacacgagcgcgcuguccgggucggcccagcacguggaggagugcuccugcuacccccgcuaccccggcgugcggugcgucugccgcgacaacuggaaggggagcaaccggccgaucguggacaucaacaucaaggacuacuccaucgugagcuccuacgucugcucgggccuggugggcgacacgccccgcaagaacgacuccagcuccucgucccacugccucgaccccaacaacgaggagggcgggcacggggucaagggcugggccuucgacgacgggaacgacguguggaugggccggaccaucagcgagaagcugcgcuccggcuacgagaccuucaaggugaucgagggguggagcaaccccaacuccaagcugcagaucaaccggcaggucaucguggaccgcggcaaccggucgggguacuccggcaucuucagcguggagggcaagucgugcaucaaccgcugcuucuacgucgagcucauccgggggcgcaaggaggagaccgaggugcuguggaccuccaacagcaucguggucuucugcggcaccuccgggaccuacggcacggggagcuggccggacggcgccgacaucaaccugaugcccaucuga

SEQ ID NO: 24636 - RNA, 1410 nt, Artificial Sequence
  derived and/or modified CDS sequence (AUadapt) from InfluenzaA__AFJ75094__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagaagaacaucaccgagaucguguaccucaccaacaccacgaucgagaaggagaucugccccaagcuggccgaguaccgcaacuggucgaagccgcagugcgacaucaccggguucgcgcccuucuccaaggacaacagcauccggcuguccgccggcggggacaucugggucacccgcgagcccuacgugucgugcgaccccgacaagugcuaccaguucgcccucggccaggggaccacgcugaacaacgugcacuccaacgacaccguccgggaccgcaccccguaccggacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcgccugguggacuccaucgugagcugguccaaggagauccugcggacccaggagucggagugcgucugcaucaacggcacgugcaccguggugaugaccgacggguccgccagcggcaaggccgacaccaagauccucuucaucgaggagggcaagaucguccacacgucgacccuguccgggagcgcgcagcacguggaggagugcuccugcuacccccgcuaccccggcgugcggugcgucugccgcgacaacuggaaggggucgaaccggccgaucguggacaucaacaucaaggaccacuccaucgugagcuccuacgucugcucgggccuggugggcgacacgccccgcaagaacgacuccagcuccagcuccaacugccucgaccccaacaacgaggagggcgggcacggggugaagggcugggccuucgacgacgggaacgacgucuggaugggccggaccaucucggagaagucccgccugggcuacgagaccuucaaggugaucgagggguggagcaaccccaacuccaagcugcagaucaaccggcaggucaucguggaccgcggcaaccggucgggguacuccggcaucuucagcguggagggcaagucgugcaucaaccgcugcuucuacgucgagcucauccgggggcgcaaggaggagaucgaggugcuguggaccuccaacagcaucguggucuucugcggcaccuccgggaccuacggcacggggagcuggccggacggcgccgacaucaacaucaugcccaucuga

SEQ ID NO: 24637 - RNA, 1413 nt, Artificial Sequence
  derived and/or modified CDS sequence (AUadapt) from InfluenzaA__AFJ75104__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccccggucacccuggccggcaacucgucccugugcagcaucuccggcugggccauccacaccaaggacaacucgauccggaucggguccaagggcgacguguucgugauccgcgagcccuucaucagcugcucccaccucgagugcaagacguucuuccugacccagggggcccugcucaacgacaagcacucgaacggcaccgucaaggaccggucccccuaccgcgcccugaugagcugcccccugggggaggcgccgucccccuacaacucgaaguucgagagcguggccugguccgccagcgccugccacgacggcaucggcuggcucaccaucgggaucuccggccccgacaacggggcgguggccguccugaaguacaacggcaucaucacgggcaccaucaagucguggaagaagcagauccugcggacccaggaguccgagugcgugugcaugaacgggagcugcuucaccaucaugacggacggccccuccaacggggccgccucguacaagaucuucaagaucgagaagggcaaggugaccaaguccauggagcucaacgccccgaacuuccacuacgaggagugcagcugcuaccccgacaccgggaccgucaugugcgugugccgcgacaacuggcacggcuccaaccggcccugggugucguucaaccagaaccuggacuaccagaucggcuacaucugcuccggggucuucggcgacaacccccgcccggaggacggggagggcagcugcaaccccgugacgguggacggggcgaacggcgucaagggcuucuccuacaaguacgggaacggcguguggaucgggcggaccaagucgaaccgcauccggaagggcuucgagaugaucugggaccccaacggguggaccaacaccgacuccgacuucagcgugaagcaggacaucgucgccaucacggacugguccggcuacucgggcagcuucgugcagcaccccgagcugaccgggcucgacugcauccgcccgugcuucuggguggagcugguccggggccugccccgcgagaacaccaccaucuggacguccgggucguccaucagcuucugcggcgugaacuccgacaucgccaacuggagcuggcccgacggcgccgagcuccccuucaccaucgacaaguga

SEQ ID NO: 24638 - RNA, 1410 nt, Artificial Sequence; identical to SEQ ID NO: 18286
  derived and/or modified CDS sequence (AUadapt) from InfluenzaA__AFJ75114__NA

SEQ ID NO: 24639 - RNA, 1410 nt, Artificial Sequence; identical to SEQ ID NO: 18286
  derived and/or modified CDS sequence (AUadapt) from InfluenzaA__AFJ75452__NA

SEQ ID NO: 24640 - RNA, 1410 nt, Artificial Sequence; identical to SEQ ID NO: 18286
  derived and/or modified CDS sequence (AUadapt) from InfluenzaA__AFJ75463__NA

SEQ ID NO: 24641 - RNA, 1413 nt, Artificial Sequence; identical to SEQ ID NO: 24637
  derived and/or modified CDS sequence (AUadapt) from InfluenzaA__AFJ75552__NA

SEQ ID NO: 24642 - RNA, 1413 nt, Artificial Sequence
  derived and/or modified CDS sequence (AUadapt) from InfluenzaA__AFJ75574__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccccggucacccuggccggcaacucgucccugugcagcaucuccggcugggccauccacaccaaggacaacucgauccggaucggguccaagggcgacguguucgugauccgcgagcccuucaucagcugcucccaccucgagugcaagacguucuuccugacccagggggcccugcucaacgacaagcacucgaacggcaccgucaaggaccggucccccuaccgcgcccugaugagcugcccccugggggaggcgccgucccccuacaacucgaaguucgagagcguggccugguccgccagcgccugccacgacggcaucggcuggcucaccaucgggaucuccggccccgacaacggggcgguggccguccugaaguacaacggcaucaucacgggcaccaucaagucguggaaggggcagauccugcggacccaggaguccgagugcgugugcaugaacggcagcugcuucaccaucaugacggacgggcccuccaacggcgccgccucguacaagaucuucaagaucgagaaggggaaggugaccaaguccauggagcucaacgccccgaacuuccacuacgaggagugcagcugcuaccccgacaccggcaccgucaugugcgugugccgcgacaacuggcacggcuccaaccggcccugggugucguucaaccagaaccuggacuaccagaucggguacaucugcuccggcgucuucggggacaacccccgcccggaggacggcgaggggagcugcaaccccgugacgguggacggcgcgaacggcgucaagggguucuccuacaaguacggcaacgggguguggaucggccggaccaagucgaaccgcauccggaagggguucgagaugaucugggaccccaacggcuggaccaacaccgacuccgacuucagcgugaagcaggacaucgucgccaucacggacugguccggcuacucggggagcuucgugcagcaccccgagcugaccggccucgacugcauccgcccgugcuucuggguggagcugguccgggggcugccccgcgagaacaccaccaucuggacguccggcucguccaucagcuucugcggcgugaacuccgacaucgccaacuggagcuggcccgacggggccgagcuccccuucaccaucgacaaguga

SEQ ID NO: 24643 - RNA, 1410 nt, Artificial Sequence; identical to SEQ ID NO: 18286
  derived and/or modified CDS sequence (AUadapt) from InfluenzaA__AFJ75585__NA

SEQ ID NO: 24644 - RNA, 1410 nt, Artificial Sequence
  derived and/or modified CDS sequence (AUadapt) from InfluenzaA__AFJ75596__NA
augaaccccaaccagaagaucaucaccaucggcucggugucccugaccaucucgacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgggaucaccggcuucgcgcccuucuccaaggacaacucgauccgccuguccgccgggggcgacaucugggucacccgggagcccuacgugagcugcgaccccgacaagugcuaccaguucgcccucgggcagggcacgacccugaacaacgugcacuccaacaacaccguccgcgaccggaccccguaccgcacgcugcucaugaacgagcugggcgugcccuuccaccuggggaccaagcaggucugcaucgccuggucguccagcuccugccacgacggcaaggccuggcuccacgugugcaucaccggggacgacaagaacgcgaccgccucguucaucuacaacggccggcugguggacuccaucgugagcugguccaaggagauccugcgcacgcaggagucggagugcgucugcaucaacgggaccugcaccguggugaugaccgacggcuccgccagcggcaaggccgacacgaagauccucuucaucgaggaggggaagaucguccacaccucgacccuguccggcagcgcgcagcacguggaggagugcuccugcuacccccgguaccccggggugcgcugcgucugccgggacaacuggaagggcucgaaccgcccgaucguggacaucaacaucaaggaccacuccaucgugagcuccuacgucugcucgggccuggugggggacacgccccggaagaacgacuccagcuccucgucccacugccucgaccccaacaacgaggagggcgggcacggcgugaaggggugggccuucgacgacggcaacgacgucuggaugggccgcaccaucagcgagaagucccggcugggguacgagaccuucaaggugaucgagggcuggucgaaccccaaguccaagcugcagaucaaccgccaggucaucguggaccgggggaaccgcagcggcuacuccgggaucuucucgguggagggcaagagcugcaucaaccggugcuucuacgucgagcucauccgcggccggaaggaggagaccgaggugcuguggaccuccaacucgaucguggucuucugcgggacguccggcaccuacgggaccggcagcuggccggacggggccgacaucaaccugaugcccaucuga

SEQ ID NO: 24645 - RNA, 1410 nt, Artificial Sequence
  derived and/or modified CDS sequence (AUadapt) from InfluenzaA__AFJ75607__NA
augaaccccacccagaagaucaucaccaucggcucggugucccugacgaucucgaccaucugcuucuucaugcagaccgccauccucaucaccacggucacccugcacuucaagcaguacgaguucaacuccccgcccaacaaccaggugaugcugugcgagcccaccaucaucgagcgcaacaucaccgagaucguguaccucacgaacaccaccaucgagaaggagaucugccccaagcuggccgaguaccggaacuggagcaagccgcagugcgacaucaccggguucgcgcccuucuccaaggacaacucgauccgccuguccgccggcggggacaucugggucacgcgggagcccuacgugagcugcgaccccgagaagugcuaccaguucgcccucggccaggggaccacccugaacaacgugcacuccaacaacaccguccgcgaccggacgccguaccgcacccugcucaugaacgagcugggcgugcccuuccaccugggcaccaagcaggucugcaucgccuggucguccagcuccugccacgacgggaaggccuggcuccacgugugcaucaccggcgacgacaagaacgcgacggccucguucaucuacaacgggcggcugguggacuccaucgugagcugguccaaggagauccugcgcacccaggagucggagugcgucugcaucaacgggaccugcaccguggugaugacggacggcuccgccagcggcaaggccgacaccaagauccucuucaucgaggagggcaagaucguccacaccucgaagcuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucgggguccagccacugccucgaccccaacaacgaggagggcgggcacggcgugaaggggugggccuucgacgacggcaacgacgucuggaugggccgcaccaucuccgagaagucccggcugggguacgagaccuucaaggugaucgagggcuggucgaaccccaagagcaagcugcagaucaaccgccaggucaucguggaccgggggaaccgcuccggcuacucggggaucuucuccguggagggcaagagcugcaucaaccggugcuucuacgucgagcucauccgcggccggaaggaggagaccgaggugcuguggaccucgaacuccaucguggucuucugcgggacgagcggcaccuacgggaccggcuccuggccggacggggccgacaucaaccugaugcccaucuga

SEQ ID NO: 24646 - RNA, 1410 nt, Artificial Sequence
  derived and/or modified CDS sequence (AUadapt) from InfluenzaA__AFJ75633__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggacauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaagaaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 24647 - RNA, 1413 nt, Artificial Sequence; identical to SEQ ID NO: 19863
  derived and/or modified CDS sequence (AUadapt) from InfluenzaA__AFJ75654__NA

SEQ ID NO: 24648 - RNA, 1410 nt, Artificial Sequence; identical to SEQ ID NO: 18286
  derived and/or modified CDS sequence (AUadapt) from InfluenzaA__AFJ75665__NA

SEQ ID NO: 24649 - RNA, 1413 nt, Artificial Sequence
  derived and/or modified CDS sequence (AUadapt) from InfluenzaA__AFJ75676__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccccggucacccuggccggcaacucgucccugugcagcaucuccggcugggccauccacaccaaggacaacucgauccggaucggguccaagggcgacguguucgugauccgcgagcccuucaucagcugcucccaccucgagugcaagacguucuuccugacccagggggcccugcucaacgacaagcacucgaacggcaccgucaaggaccggucccccuaccgcgcccugaugagcugcccccugggggaggcgccgucccccuacaacucgaaguucgagagcguggccugguccgccagcgccugccacgacggcaucggcuggcucaccaucgggaucuccggccccgacaacggggcgguggccguccugaaguacaacggcaucaucacgggcaccaucaagucguggaagaagcagauccugcggacccaggaguccgagugcgugugcaugaacgggagcugcuucaccaucaugacggacggccccuccaacggggccgccucguacaagaucuucaagaucgagaagggcaaggugaccaaguccauggagcucaacgccccgaacuuccacuacgaggagugcagcugcuaccccgacaccgggaccgucaugugcgugugccgcgacaacuggcacggcuccaaccggcccugggugucguucaaccagaaccuggacuaccagaucggcuacaucugcuccggggucuucggcgacaacccccgcccgaaggacggggagggcagcugcaaccccgugacgguggacggggcgaacggcgucaagggcuucuccuacaaguacgggaacggcguguggaucgggcggaccaagucgaaccgcauccggaagggcuucgagaugaucugggaccccaacggguggaccaacaccgacuccgacuucagcgugaagcaggacaucgucgccaucacggacugguccggcuacucgggcagcuucgugcagcaccccgagcugaccgggcucgacugcauccgcccgugcuucuggguggagcugguccggggccugccccgcgagaacaccaccaucuggacguccgggucguccaucagcuucugcggcgugaacuccgacaucgccaacuggagcuggcccgacggcgccgagcuccccuucaccaucgacaaguga

SEQ ID NO: 24650 - RNA, 1413 nt, Artificial Sequence; identical to SEQ ID NO: 19863
  derived and/or modified CDS sequence (AUadapt) from InfluenzaA__AFJ75687__NA

SEQ ID NO: 24651 - RNA, 1410 nt, Artificial Sequence; identical to SEQ ID NO: 16318
  derived and/or modified CDS sequence (AUadapt) from InfluenzaA__AFJ76122__NA

SEQ ID NO: 24652 - RNA, 1410 nt, Artificial Sequence; identical to SEQ ID NO: 23718
  derived and/or modified CDS sequence (AUadapt) from InfluenzaA__AFJ76134__NA

SEQ ID NO: 24653 - RNA, 1410 nt, Artificial Sequence; identical to SEQ ID NO: 16318
  derived and/or modified CDS sequence (AUadapt) from InfluenzaA__AFJ76146__NA

SEQ ID NO: 24654 - RNA, 1410 nt, Artificial Sequence; identical to SEQ ID NO: 16318
  derived and/or modified CDS sequence (AUadapt) from InfluenzaA__AFJ76159__NA

SEQ ID NO: 24655 - RNA, 1410 nt, Artificial Sequence; identical to SEQ ID NO: 16318
  derived and/or modified CDS sequence (AUadapt) from InfluenzaA__AFJ76173__NA

SEQ ID NO: 24656 - RNA, 1410 nt, Artificial Sequence; identical to SEQ ID NO: 16318
  derived and/or modified CDS sequence (AUadapt) from InfluenzaA__AFJ76191__NA

SEQ ID NO: 24657 - RNA, 1413 nt, Artificial Sequence
  derived and/or modified CDS sequence (AUadapt) from InfluenzaA__AFJ76192__NA
augaaccccaaccagaagaucaucaccaucggcucgaucuccaucgccaucgggaucaucagccugauggugcagaucggcaacaucaucuccaucugggccucgcacuccauccagaccgggauccagaacaacacgggcaucugcaaccagcgcaucaucaccuacgagaacagcaccugggucaaccacaccuacgugaacaucaacaacacgaacguggucgcgggggaggacaagaccuccgugacccucgccggcaacagcucccugugcucgaucuccggcugggccaucuacaccaaggacaacagcauccggaucggguccaagggcgacguguucgucauccgcgagccguucaucagcugcucccaccuggagugccggacguucuuccucacccagggggcccugcugaacgacaagcacucgaacggcaccgugaaggaccgcucccccuaccgggcccucaugagcugcccccugggggaggcgcccuccccguacaacagcaaguucgagucgguggccugguccgccagcgccugccacgacggcaugggcuggcugaccaucgggaucuccggccccgacaacggggcggucgccgugcucaaguacaacggcaucaucacgggcaccaucaagagcuggaagaagcagauccugcgcacccaggaguccgagugcgugugcaugaacgggucgugcuucaccaucaugacggacggccccuccaacaaggccgccagcuacaagaucuucaagaucgagaaggggaaggucaccaaguccaucgagcugaacgcccccaacuucuacuacgaggagugcagcugcuacccggacaccggcaucgugaugugcgugugccgggacaacuggcacggguccaaccgccccugggucucguucaaccagaaccucgacuaccagaucggcuacaucugcuccggcguguucggggacaacccccggcccgaggacggcgaggggagcugcaacccggugaccgucgacggcgcgaacggggugaagggcuucuccuacaaguacggcaacgggguguggaucggccgcaccaagagcaaccggcugcgcaagggguucgagaugaucugggaccccaacggcuggacgaacaccgacuccgacuucucggucaagcaggacgugguggccaucaccgacugguccggguacagcggcagcuucguccagcaccccgagcugacgggccucgacugcauccggcccugcuucuggguggagcugguccgcgggcugccgcgggagaacaccaccaucuggaccuccggcucguccaucagcuucugcggggugaacuccgacacggccaacuggagcuggcccgacggcgccgagcuccccuucaccaucgacaaguga

SEQ ID NO: 24658 - RNA, 1410 nt, Artificial Sequence; identical to SEQ ID NO: 16318
  derived and/or modified CDS sequence (AUadapt) from InfluenzaA__AFJ76206__NA

SEQ ID NO: 24659 - RNA, 1410 nt, Artificial Sequence
  derived and/or modified CDS sequence (AUadapt) from InfluenzaA__AFJ76216__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucaagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcacggggagcuggccggacggcgccgacaucaaccugaugcccaucuga

SEQ ID NO: 24660 - RNA, 1410 nt, Artificial Sequence
  derived and/or modified CDS sequence (AUadapt) from InfluenzaA__AFJ77411__NA
augaaccccaaccagaagaucaucaccaucggcucggugucccugaccaucgccacgaucugcuuccucaugcagaucgucauccuggugaccaccgugacccugcacuucaagcaguacgagugcaacagcccgcccaacaaccaggucaugcucugcgagcccacgaucaucgagcgcaacaucaccgagaucguguaccugaccaacaccacgaucgagaaggagaucugccccaagcuggccgaguaccggaacugguccaagccgcagugcaagaucaccggguucgcgcccuucucgaaggacaacuccauccgccucagcgccggcggggacaucugggugacccgggagcccuacgucuccugcgaccccggcaagugcuaccaguucgcccuggggcagggcaccacgcugaacaaccgccacucgaacgacaccgugcacgaccggaccccguaccgcacccuccugaugaacgagcugggcgugcccuuccaccucgggacgaagcaggucugcaucgccugguccagcuccucgugccacgacggcaaggccuggcugcacgugugcgugaccgggcacgacgagaacgcgaccgccuccuucaucuacgacggccggcuggucgacagcaucggguccuggucgaagaacauccuccgcacccaggaguccgagugcgugugcaucaacggcacgugcaccguggucaugaccgacggcagcgccuccgagcgggccgacaccaagauccuguucaucgaggaggggaagaucgugcacaucucgccccugagcggcuccgcgcagcacguggaggagugcucgugcuacccccgcuacccggggguccggugcgugugccgcgacaacuggaagggcuccaaccggcccaucguggacaucaacgucaaggacuacagcaucguguccucguacgugugcuccggccucgucggggacacgccccgcaagaacgacagcuccucguccagcuacugccugaaccccaacaacgaggagggcgggcacggcgugaaggggugggccuucgacgacggcaacgacgucuggaugggccggaccaucuccgagaagcugcgcucgggguacgagaccuucaaggugaucggcgggugguccaagccgaacagcaagcuccagaucaaccgccaggugaucgucgaccggggcaaccgguccggguacucgggcaucuucuccguggagggcaagagcugcgugaaccgcugcuucuacgucgagcugauccgggggcgcaagcaggagaccgaggugugguggacgucgaacuccaucguggucuucugcggcaccagcgggaccuacggcaccggguccuggcccgacggcgccgacaucaaccugaugcccaucuga

SEQ ID NO: 24661 - RNA, 1410 nt, Artificial Sequence
  derived and/or modified CDS sequence (AUadapt) from InfluenzaA__AFJ77422__NA
augaaccccaaccagaagaucaucaccaucggcucggugucccugaccaucgccacgaucugcuuccucaugcagaucgccauccuggucaucaccgugacccugcacuucaagcaguacgagugcaacagcccgcccaacaaccaggugaugcucugcgagcccaccaucaucgagcgcaacaucacggagaucgucuaccugaccaacaccaccaucgagaaggagaucugccccaagcuggcggaguaccggaacugguccaagccgcagugcaagaucacgggguucgcccccuucucgaaggacaacuccauccgccucagcgccggcggggacaucugggugacccgggagcccuacguguccugcgaccccgacaagugcuaccaguucgcccugggccaggggaccacccugaacaaccgccacucgaacgacacgguccacgaccggaccccguaccgcacccuccugaugaacgagcugggcgugcccuuccaccucggcaccaagcaggucugcaucgccugguccagcuccucgugccacgacgggaaggcguggcugcacgugugcgugacgggccacgacgagaacgccaccgccuccuucaucuacgacgggcggcugguggacagcaucggcuccuggucgaagaagauccuccgcacccaggaguccgagugcgucugcaucaacgggaccugcacgguggugaugaccgacggcagcgccuccggccgggcggacaccaagauccuguucaucgaggaggggaagaucguccacaucucgccccugagcggcuccgcccagcacguggaggagugcucgugcuacccccgcuacuccggggugcggugcgucugccgcgacaacuggaagggcagcaaccggccgaucguggacaucaacgugaaggacuacuccaucgucucguccuucgugugcagcggccucgugggggacacgccccgcaagaacgacuccucguccagcucccacugccugaaccccaacaacgaggagggcgggcacggcgucaaggggugggccuucgacgacggcaacgacguguggaugggccggaccaucucggagaagcugcgcuccggguacgagaccuucaaggucaucggcggguggagcaagcccaacuccaagcuccagaucaaccgccaggugaucguggaccggggcaaccggucgggguacuccggcaucuucagcgucgagggcaagucgugcaucaaccgcugcuucuacguggagcugauccgggggcgcaagcaggagaccgaggugugguggaccuccaacagcaucgucguguucugcggcacguccgggaccuacggcaccgggagcuggccggacggcgccgacaucaaccugaugcccaucuga

SEQ ID NO: 24662 - RNA, 1410 nt, Artificial Sequence
  derived and/or modified CDS sequence (AUadapt) from InfluenzaA__AFJ77433__NA
augaaccccaaccagaagaucaucaccaucggcucggugucccugaccaucgccacgaucugcuuccucaugcagaucgucauccuggugaccaccgugacccugcacuucaagcaguacgagugcaacucgccgcccaacaaccaggucaugcucugcgagcccacgaucaucgagcgcaacaucaccgagaucguguaccugaccaacaccacgaucgagaaggagaucugccccaagcuggccgaguaccggaacugguccaagccgcagugcaagaucaccggguucgcgcccuucagcaaggacaacuccauccgccucucggccggcggggacaucugggugacccgggagcccuacgucuccugcgaccccggcaagugcuaccaguucgcccuggggcagggcaccacgcugaacaaccgccacagcaacgacaccgugcacgaccggaccccguaccgcacccuccugaugaacgagcugggcgugcccuuccaccucgggacgaagcaggucugcaucgccugguccucguccagcugccacgacggcaaggccuggcugcacgugugcgugaccgggcacgacgagaacgcgaccgccuccuucaucuacgacggccggcuggucgacucgaucggguccuggagcaagaacauccuccgcacccaggaguccgagugcgugugcaucaacggcacgugcaccguggucaugaccgacggcucggccuccgagcgggccgacaccaagauccuguucaucgaggaggggaagaucgugcacaucagcccccugucgggcuccgcgcagcacguggaggagugcucgugcuacccccgcuacccggggguccggugcgugugccgcgacaacuggaagggcuccaaccggcccaucguggacaucaacgucaaggacuacagcaucguguccucguacgugugcuccggccucgucggggacacgccccgcaagaccgacagcuccucguccagcgacugccugaaccccaacaacgaggagggcgggcacggcgugaaggggugggccuucgacgacggcaacgacgucuggaugggccggaccaucuccgagaagcugcgcucgggguacgagaccuucaaggugaucggcgggugguccaagccgaacagcaagcuccagaucaaccgccaggugaucgucgaccggggcaaccgguccggguacucgggcaucuucuccguggagggcaagagcugcgugaaccgcugcuucuacgucgagcugauccgggggcgcaagcaggagacggaggugugguggaccucgaacuccaucguggucuucugcggcaccagcgggaccuacggcacgggguccuggcccgacggcgccgacaucaaccugaugcccaucuga

SEQ ID NO: 24663 - RNA, 1410 nt, Artificial Sequence
  derived and/or modified CDS sequence (AUadapt) from InfluenzaA__AFJ77443__NA
augaaccccaaccagaagaucaucaccaucggcucggugucccugaccaucgccacgaucugcuuccucaugcagaucgccauccuggucaucacccugacccuccacuucaagcaguacgagugcaacagcccgcccaacaaccaggugaugcugugcgagcccaccaucaucgagcgcaacaucacggagaucguguaccugaccaacaccaccaucgagaaggagaucugccccaagcucgcggaguaccggaacugguccaagccgcagugcaagaucacgggguucgcccccuucucgaaggacaacuccauccgccugagcgccggcggggacaucugggucacccgggagcccuacguguccugcgaccccggcaagugcuaccaguucgcccuggggcagggcaccacccucaacaaccgccacucgaacgacacggugcacgaccggaccccguaccgcacccugcugaugaacgagcucggcguccccuuccaccuggggaccaagcaggucugcaucgccugguccagcuccucgugccacgacggcaaggcguggcugcacgugugcgugacggggcacaacgagaacgccaccgccuccuucaucuacgacggccggcucguggacagcaucggguccuggucgaagaacauccugcgcacccaggaguccgagugcgugugcaucaacgggaccugcacggucgugaugaccgacggcagcgccuccgggcgggcggacaccaagauccuguucaucgaggagggcaagaucgugcacaucucgccccucagcggguccgcccagcacgucgaggagugcucgugcuacccccgcuacccgggcgugcggugcgugugccgcgacaacuggaagggcuccaaccggcccaucgucgacaucaacgugaaggacuucagcaucguguccucguacgucugcuccgggcuggugggcgacacgccccgcaagaacgacagcuccucguccagccacugccugaaccccaacaacgaggagggcggcaacggggugaagggcugggccuucgacgacggcaacgacgucuggauggggcggaccaucuccgagaagcuccgcucgggcuacgagaccuucaaggugaucgggggcugguccaagccgaacagcaagcugcagaucaaccggcaggucaucguggaccgcgggaaccgguccggcuacucgggcaucuucuccguggagggcaagagcugcaucaaccgcugcuucuacgucgagcugauccgggggcgcaagcaggagaccgaggugugguggaccucgaacuccaucguggucuucugcgggacgagcggcaccuacgggaccggcuccuggcccgacggcgccgacaucaaccucaugcccaucuga

SEQ ID NO: 24664 - RNA, 1410 nt, Artificial Sequence
  derived and/or modified CDS sequence (AUadapt) from InfluenzaA__AFJ77465__NA
augaaccccaaccagaagaucaucaccaucggcucggugucccugaccaucgccacgaucugcuuccucaugcagaucgccauccuggucaccaccgugacccugcacuucaagcaguacgagugcaacccgccgcccaacaaccaggugaugcucugcgagcccacgaucaucgagcgcaacaucaccgagaucgucuaccugaccaacaccacgaucgagaaggagaucugccccaagcuggcggaguaccggaacuggucgaagccccagugcaagaucaccggguucgcccccuucuccaaggacaacagcauccgccucuccgccggcggggacaucugggugacccgggagcccuacgugucgugcgacccggacaagugcuaccaguucgcccugggccaggggaccacgcugaacaaccgccacuccaacgacaccguccacgaccggacccccuaccgcacccuccugaugaacgagcugggcgugcccuuccaccucggcacgaagcaggucugcaucgccuggucguccagcuccugccacgacgggaaggcguggcugcacgugugcgugaccggccacgacgagaacgccaccgccucguucaucuacgacgggcggcugguggacuccaucggcagcugguccaagaagauccuccgcacccaggagucggagugcgucugcaucaacgggacgugcaccguggugaugaccgacggcuccgccucgggccgggcggacaccaagauccuguucaucgaggaggggaagaucguccacaucagcccccuguccggcucggcccagcacguggaggagugcuccugcuacccgcgcuaccccggggugcggugcgucugccgcgacaacuggaagggcucgaaccggcccaucguggacaucaacgugaagaacuacuccaucgucagcuccuacgugugcucgggccucgugggggacacgccccgcaagaacgacuccagcuccucgucccacugccugaacccgaacaacgaggagggcgggcacggcgucaaggggugggccuucgacgacggcaacgacguguggaugggccggaccaucucggagaagcugcgcuccggguacgagaccuucaaggucaucgagggcuggagcaagcccaacuccaagcuccagaucaaccgccaggugaucguggaccgggggaaccggucgggcuacuccgggaucuucucggucgagggcaaguccugcaucaaccgcugcuucuacguggagcugauccggggccgcaagcaggagaccgaggugugguggacgagcaacucgaucgucguguucugcgggaccuccggcaccuacgggaccggcagcuggcccgacggggccgacaucaaccugaugcccaucuga

SEQ ID NO: 24665 - RNA, 1410 nt, Artificial Sequence
  derived and/or modified CDS sequence (AUadapt) from InfluenzaA__AFJ77476__NA
augaaccccaaccagaagaucaucaccaucggcucggugucccugaccaucgccacgaucugcuuccucaugcagaucgccauccuggucaccaccgugacccugcacuucaagcaguacgagugcaacagccucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucucgaaggacaacuccauccgccugagcgccggcggggacaucugggugacccgggagcccuacguguccugcgaccccgacaagugcuaccaguucgcccugggccaggggaccacgcucaacaaccgccacucgaacgacaccguccacgaccggacccccuaccgcacccugcugaugaacgagcucggcgugccguuccaccugggcacgaagcaggucugcaucgccugguccagcuccucgugccacgacgggaaggcguggcugcacgugugcgugaccggccacgacgagaacgccaccgccuccuucaucuacgggggccggcucguggacagcaucggguccuggucgaagaagauccugcgcacccaggaguccgagugcgucugcaucaacggcacgugcaccguggugaugaccgacggcagcgccuccgggcgggcggacaccaagauccuguucaucgaggagggcaagaucauccacaucucgcagcucagcggguccgcccagcacgucgaggagugcucgugcuacccccgcuaccccggcgugcggugcgugugccgcgacaacuggaagggcuccaaccggcccaucgucgacaucaacgugaaggacuacagcaucguguccucguacgucugcuccgggcuggugggcgacacgccgcgcaagaacgacagcuccucguccagccacugccuggaccccaacaacgaggagggcgggcacggggugaagggcugggccuucgacgacggcaacgacgucuggauggggcggaccaucuccgagaaguuccgcucgggcuacgagaccuucaaggugaucgaggggugguccaagcccaacagcaagcuccagaucaaccggcagaucaucgucgaccgcgacaaccgguccggcuacucggggaucuucuccguggagggcaagagcugcaucaaccgcugcuucuacguggagcugauccggggccgcaagcaggagaccgaggucugguggacgucgaacuccaucgugguguucugcgggaccagcggcaccuacgggaccggcuccuggcccgacggggccgacaucaaccugaugccgaucuga

SEQ ID NO: 24666 - RNA, 1410 nt, Artificial Sequence; identical to SEQ ID NO: 16717
  derived and/or modified CDS sequence (AUadapt) from InfluenzaA__AFJ77487__NA

SEQ ID NO: 24667 - RNA, 1410 nt, Artificial Sequence
  derived and/or modified CDS sequence (AUadapt) from InfluenzaA__AFJ77498__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccucguccucgugccacgacgggaaggcguggcugcacgugugcgugaccggccacgacgagaacgccaccgccuccuucaucuacgacgggcggcugguggacagcaucggcuccuggucgaagaagauccuccgcacccaggaguccgagugcgucugcaucaacgggacgugcaccguggugaugaccgacggcagcgccuccggccgggcggacaccaagauccuguucaucgaggaggggaagaucguccacacgucgaagcugucgggcuccgcccagcacguggaggagugcagcugcuacccccgcuaccccggggugcggugcgucugccgcgacaacuggaagggcuccaaccggccgaucguggacaucaacgugaaggacuacucgaucaucuccagcuacgucugcuccggccucgugggggacacgccccgcaagaacgacucguccucguccagccacugccuggaccccaacaacgaggagggcgggcacggcgugaaggggugggccuucgacgacggcaacgacgucuggaugggccggaccaucuccgagaagucccgcucgggguacgagaccuucaaggugaucgagggcuggagcaagcccaacuccaagcugcagaucaaccggcaggucaucguggagcgcgggaacaugucgggcuacuccgggaucuucucgguggagggcaagagcugcaucaaccggugcuucuacgucgagcucauccgcggccggaagcaggagaccgaggugugguggaccuccaacucgaucguggucuucugcgggaccuccggcaccuacgggacgggcagcuggccggacggggccgacaucaaccugaugcccaucuga

SEQ ID NO: 24668 - RNA, 1410 nt, Artificial Sequence; identical to SEQ ID NO: 16717
  derived and/or modified CDS sequence (AUadapt) from InfluenzaA__AFJ77509__NA

SEQ ID NO: 24669 - RNA, 1410 nt, Artificial Sequence
  derived and/or modified CDS sequence (AUadapt) from InfluenzaA__AFJ77520__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccagcugccacgacggcaaggcguggcugcacgugugcgugaccggggacgacgagaacgccaccgccuccuucaucuacaacggccgccugguggacucgaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgagccuguccgggucggcccagcacguggaggagugcuccugcuacccccgcuaccccggcgugcggugcgucugccgcgacaacuggaagggcagcaaccggccgaucguggacaucaacgugaaggacuacuccaucgucucguccuacgugugcagcgggcucgugggcgacacgccccgcaagaacgacuccucguccucgucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggucgaagcccaacuccaagcuccagaucaaccgccaggugaucguggaccggggcaaccggagcggguacuccggcaucuucucggucgagggcaagagcugcaucaaccgcugcuucuacguggagcugauccgggggcgcaagcaggagaucgaggugcuguggaccuccaacucgaucgucguguucugcggcaccuccgggaccuacggcaccgggagcuggccggacggcgccgacaucaaccucaugcccaucuga

SEQ ID NO: 24670 - RNA, 1410 nt, Artificial Sequence
  derived and/or modified CDS sequence (AUadapt) from InfluenzaA__AFJ77531__NA
augaaccccaaccagaagaucaucaccaucggcucggugucccugaccaucacgaccaucugcuuccucaugcagaucgccauccuggucaucaccgugacccugcacuucaagcagugcgagugcaacagcccgcccaacaaccaggugaugcucugcgagcccacgaucaucgagcgcaacaucaccgagaucgucuaccugaccaacaccacgaucgagaaggagaucugccccaagcuggccgaguaccggaacugguccaagccgcagugcaaggugaccggguucgcgcccuucucgaaggacaacuccauccgccucagcgccggcggggacaucugggugacccgggagcccuacgucuccugcgaccccggcaagugcuaccaguucgcccuggggcagggcaccacgcugaacaaccgccacucgaacgacaccgugcacgaccggaccccguaccgcacccuccugaugaacgagcugggcgugcccuuccaccucgggacgaagcaggucugcaucgccugguccagcuccucgugccacgacggcaaggccuggcugcacgugugcgugaccgggcacaacgagaacgcgaccgccuccuucaucuacgacggccggcuggucgacagcaucggguccuggucgaagaacauccuccgcacccaggaguccgagugcgugugcaucaacggcacgugcaccguggucaugaccgacggcagcgccuccgggcgggccgacaccaagauccuguucaucgaggagggcaagaucgugcacaucucgccccugagcggguccgcgcagcacguggaggagugcucgugcuacccccgcuacccgggcguccggugcgugugccgcgacaacuggaagggcuccaaccggcccaucguggacaucaacgucaaggacuacagcaucguguccucguacgugugcuccgggcucgucggcgacacgccccgcaagaacgacagcuccucguccagcuacugccuggaccccaacaacgaggagggcgggcacggggugaagggcugggccuucgacgacggcaacgacgucuggauggggcggaccaucuccgagaagcugcgcucgggcuacgagaccuucaaggugaucgggggcugguccaagccgaacagcaagcuccagaucaaccgccaggugaucgucgaccgggggaaccgguccggcuacucgggcaucuucuccguggagggcaagagcugcaucaaccgcugcuucuacguggagcugauccgggggcgcaagcaggagaccgaggucugguggacgucgaacuccaucgugguguucugcgggaccagcggcaccuacgggaccggcuccuggcccgacggcgccgacaucaaccugaugcccaucuga

SEQ ID NO: 24671 - RNA, 1410 nt, Artificial Sequence
  derived and/or modified CDS sequence (AUadapt) from InfluenzaA__AFJ77542__NA
augaaccccaaccagaagaucaucaccaucggcucggugucccugaccaucucgacgaucugcuuccucaugcagaucgccauccuggucaccaccgugacccugcacuucaagcaguacgagugcaacuccccgcccaacaaccaggugaugcucugcgagcccacgaucaucgagcgcaacaucaccgagaucgucuaccugaccaacaccacgaucgagaaggagaucugccccaagcuggccgaguaccggaacuggagcaagccgcagugcaacaucaccggguucgcgcccuucuccaaggacaacucgauccgccucuccgccggcggggacaucugggugacccgggagcccuacgugagcugcgaccccgacaagugcuaccaguucgcccugggccaggggaccacgcugaacaacggccacuccaacgacaccguccacgaccgcaccccguaccggacccuccugaugaacgagcugggcgugcccuuccaccucgggacgaagcaggucugcaucgccuggucguccucguccugccacgacggcaaggccuggcugcacgugugcgugaccggggacgacgagaacgcgaccgccagcuucaucuacaacggccgccugguggacuccaucgggucgugguccaagaagauccuccggacccaggagagcgagugcgucugcaucaacggcacgugcaccguggugaugaccgacggcuccgccucggggaaggccgacaccaagauccuguucaucgaggagggcaagaucguccacacgucgacccuguccgggagcgcgcagcacguggaggagugcuccugcuacccccgcuaccccggcgugcggugcgucugccgcgacaacuggaagggcucgaaccggccgaucguggacaucaacaucaaggacuacuccaucgugagcuccuacgucugcucggggcucgugggcgacacgccccgcaagaacgacuccucguccagcucccacugccuggaccccaacaacgaggagggcgggcacggggugaagggcugggccuucgacgacggcaacgacgucuggauggggcggaccaucucggagaagcugcgcuccggcuacgagaccuucaaggugaucgagggguggagcaagcccaacuccaagcuccagaucaaccggcaggucaucguggaccgcggcaaccggucgggguacuccggcaucuucucgguggagggcaagagcugcaucaaccgcugcuucuacgucgagcugauccgggggcgcaagcaggagaccgaggugcuguggaccuccaacucgaucguggucuucugcggcaccuccgggacguacggcaccgggagcuggccggacggcgccgacaucaaccucaugcccaucuga

SEQ ID NO: 24672 - RNA, 1410 nt, Artificial Sequence; identical to SEQ ID NO: 16655
  derived and/or modified CDS sequence (AUadapt) from InfluenzaA__AFJ77553__NA

SEQ ID NO: 24673 - RNA, 1410 nt, Artificial Sequence
  derived and/or modified CDS sequence (AUadapt) from InfluenzaA__AFJ77564__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccucguccucgugccacgacgggaaggcguggcugcacgugugcgugaccggccacgacgagaacgccaccgccuccuucaucuacgacgggcggcugguggacagcaucggcuccuggucgaagaagauccuccgcacccaggaguccgagugcgucugcaucaacgggacgugcaccguggugaugaccgacggcagcgccuccggccgggcggacaccaagauccuguucaucgaggaggggaagaucguccacaucucgcagcugagcggcuccgcccagcacguggaggagugcucgugcuacccccgcuaccccggggugcggugcgucugccgcgacaacuggaagggcuccaaccggccgaucguggacaucaacgugaaggacuacucgaucgucuccagcuacgugugcuccggccucgugggggacacgccccgcaagaacgacucguccagcuccucgcacugccugaaccccaacaacgaggagggcgggcacggcgucaaggggugggccuucgacgacggcaacgacguguggaugggccggaccaucuccgagaagcugcgcucgggguacgagaccuucaaggucaucgagggcugguccaagcccaacagcaagcuccagaucaaccgccaggugaucguggaccgggggaaccgguccggcuacucggggaucuucuccgucgagggcaagagcugcaucaaccgcugcuucuacguggagcugauccggggccgcaagcaggagaacgaggugugguggaccucgaacuccaucgucguguucugcgggacgagcggcaccuacgggaccggcuccuggccggacggggccgacaucaaccugaugcccaucuga

SEQ ID NO: 24674 - RNA, 1329 nt, Artificial Sequence
  derived and/or modified CDS sequence (AUadapt) from InfluenzaA__AFJ77575__NA
augaaucccaaccagaagaucaucaccaucggcucggugucccugaccaucgccacgaucugcuuccucaugcagaucgccauccuggucaucgagcgcaacaucaccgagaucguguaccugaccaauaccacgaucgagaaggagaucugcccgaagcucgcggaguaccggaacuggagcaagccccagugcaacaucaccggguuugcccccuucuccaaggacaacagcauccgccuguccgccggcggggacaucugggugacccgggagcccuacgucaguugcgacccggacaagugcuaccaguucgcccugggccaggggaccacgcucaauaacggccacuccaacgacaccgugcacgaccgcacccccuaccggacccugcugaugaaugagcucggcgugcccuuccaccuggggacgaagcaggucugcaucgccuggagcuccagcuccugccaugacggcaaggcguggcugcacgugugcgugaccggggacgacgagaacgccaccgccaguuucaucuacaacggccgccucgucgacuccaucgggagcugguccaagaagauccugcggacccaggagagcgagugugugugcaucaacggcacgugcaccguggucaugaccgacggcuccgccucggggaaggcggacaccaagauccuguucaucgaggagggcaagaucgugcauacguccagccucagcggguccgcccagcacguggaggagugcucgugcuauccccgcuacccgggcguccggugcgugugccgcgacaacuggaagggcuccaaccggcccaucguggauaucaacgucaaggacuacagcaucguguccagcuacguguguuccgggcuggucggcgacacgccccgcaagaacgacucguccagcuccagccauugccuggaccccaacaacgaggagggcgggcacggggugaagggcugggccuucgacgauggcaacgacguguggauggggcggaccaucuccgagaagcuccgcucgggcuacgagaccuucaaggucaucgaggggugguccaagccgaacaguaagcugcagaucaaccgccaggugaucgucgaccggggcaaccgguccggguacagcggcaucuucuccguggagggcaagaguugcaucaaccgcugcuucuacguggagcugauccgggggcgcaagcaggagaccgagguccucuggaccagcaauuccaucgugguguucugcggcaccagcgggaccuacggcacgggguccuggcccgacggcgccgacaucaaccugaugcccaucuga

SEQ ID NO: 24675 - RNA, 1410 nt, Artificial Sequence
  derived and/or modified CDS sequence (AUadapt) from InfluenzaA__AFJ77597__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgaagcaggucugcaucgccugguccagcuccucgugccacgacggcaaggcguggcugcacgugugcgugaccggggacgacgagaacgccaccgccuccuucaucuacaacggccgccugguggacucgaucggguccuggagcaagaagauccuccggacccaggaguccgagugcgucugcaucaacggcacgugcaccguggugaugaccgacggcucggccuccgggaaggcggacaccaagauccuguucaucgaggagggcaagaucguccacacgcgcccccugucggggagcgcccagcacguggaggagugcuccugcuacccccgguacccgggcgugcgcugcgucugccgggacaacuggaagggcucgaaccgccccaucguggacaucaacgugaaggacuacuccaucgucucguccuacgugugcagcgggcucgugggcgacacgccccggaagaacgacuccucguccucgucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggucgaagccgaacuccaagcuccagaucaaccgccaggugaucguggaccggggcaaccgcucgggguacuccggcaucuucagcgucgagggcaaguccugcaucaaccggugcuucuacguggagcugauccgcgggcggaagcaggagaccgaggugcuguggaccucgaacucgaucgucguguucugcggcaccuccgggaccuacggcacggggagcuggcccgacggcgccgacaucaaccucaugcccaucuga

SEQ ID NO: 24676 - RNA, 1410 nt, Artificial Sequence
  derived and/or modified CDS sequence (AUadapt) from InfluenzaA__AFJ77608__NA
augaaccccaaccagaagaucaucaccaucggcucggugucccugaccaucgccacgaucugcuuccucaugcagaccgccauccuggucaccaccgugacgcugcacuucaagcaguacgagugcaacucgccgcccaacaaccaggugaugcucugcgagcccaccaucaucgagcgcaacaugaccgagaucgucuaccugaccaacacgaccaucgagaaggagaucugccccaagcuggcggaguaccggaacugguccaagccgcagugcaacaucaccggguucgcccccuucagcaaggacaacuccauccgccucucggccggcggggaccugugggugacccgggagcccuacguguccugcgaccccgacaagugcuaccaguucgcccugggccaggggacgacccucaacaacggccacucgaacgacaccguccacgaccgcaccccguaccggacgcugcugaugaacgagcucggcgugcccuuccaccuggggaccaagcaggucugcaucgccugguccagcuccucgugccacgacggcaaggcguggcugcacgugugcgugaccggggacgacgagaacgccaccgccuccuucaucuacaacggccgccucguggacucgaucggguccuggagcaagaagauccugcggacgcaggaguccgagugcgucugcaucaacgggaccugcaccguggugaugaccgacggcucggccuccgggaaggcggacacgaagauccuguucaucgaggagggcaagaucguccacaccucgagccucuccgggucggcccagcacguggaggagugcuccugcuacccccgcuaccccggcgugcggugcgucugccgcgacaacuggaagggcagcaaccggccgaucguggacaucaacgugaaggacuacuccaucgucucguccuacgugugcucggggcuggugggcgacacgccccgcaagaacgacuccagcuccucgucccacugccuggaccccaacaacgaggagggcggccacggggucaagggcugggccuucgacgacggcaacgacguguggauggggcggaccaucucggagaagcuccgcuccggcuacgagaccuucaaggucaucgagggguggagcaagcccaacuccaagcugcagaucaaccgccaggugaucguggaccggggcaaccggucgggguacuccggcaucuucucggucgagggcaagagcugcaucaaccgcugcuucuacguggagcugauccgggggcgcaagcaggagaccgaggugcucuggaccuccaacucgaucgucguguucugcggcaccuccgggacguacggcaccgggagcuggccggacggcgccgacaucaaccugaugcccaucuga

SEQ ID NO: 24677 - RNA, 1410 nt, Artificial Sequence; identical to SEQ ID NO: 24675
  derived and/or modified CDS sequence (AUadapt) from InfluenzaA__AFJ77619__NA

SEQ ID NO: 24678 - RNA, 1410 nt, Artificial Sequence; identical to SEQ ID NO: 24675
  derived and/or modified CDS sequence (AUadapt) from InfluenzaA__AFJ77630__NA

SEQ ID NO: 24679 - RNA, 1410 nt, Artificial Sequence; identical to SEQ ID NO: 24671
  derived and/or modified CDS sequence (AUadapt) from InfluenzaA__AFJ77641__NA

SEQ ID NO: 24680 - RNA, 1410 nt, Artificial Sequence; identical to SEQ ID NO: 24671
  derived and/or modified CDS sequence (AUadapt) from InfluenzaA__AFJ77652__NA

SEQ ID NO: 24681 - RNA, 1410 nt, Artificial Sequence; identical to SEQ ID NO: 16442
  derived and/or modified CDS sequence (AUadapt) from InfluenzaA__AFJ77663__NA

SEQ ID NO: 24682 - RNA, 1410 nt, Artificial Sequence; identical to SEQ ID NO: 16442
  derived and/or modified CDS sequence (AUadapt) from InfluenzaA__AFJ77674__NA

SEQ ID NO: 24683 - RNA, 1410 nt, Artificial Sequence; identical to SEQ ID NO: 16442
  derived and/or modified CDS sequence (AUadapt) from InfluenzaA__AFJ77685__NA

SEQ ID NO: 24684 - RNA, 1410 nt, Artificial Sequence
  derived and/or modified CDS sequence (AUadapt) from InfluenzaA__AFJ77696__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccucgugccacgacggcaaggcguggcugcacgugugcgugaccggggacgacgagaacgccaccgccuccuucaucuacaacggccgccugguggacagcaucggguccuggucgaagaagauccuccggacccaggaguccgagugcgucugcaucaacggcacgugcaccguggugaugaccgacggcagcgccuccgagaaggcggacaccaagauccuguucaucgaggaggggaagaucguccacacgucgcugcucagcggcuccgcccagcacguggaggagugcucgugcuacccccgcuaccccggggugcggugcgucugccgcgacaacuggaagggcuccaaccggccgaucguggacaucaacgugaaggacuacucgaucgucuccagcuacgugugcuccggccuggugggggacacgccccgcaagaacgacucguccagcuccucgcacugccuggaccccaacaacgaggagggcgggcacggcgucaaggggugggccuucgacgacggcaacgacguguggaugggccggaccaucuccgagaagcuccgcucgggguacgagaccuucaaggucaucgagggcugguccaagcccaacagcaagcugcagaucaaccgccaggugaucguggaccgggggaaccgguccggcuacucggggaucuucuccgucgagggcaagagcugcaucaaccgcugcuucuacguggagcugauccggggccgcaagcaggagaccgaggugcucuggaccucgaacuccaucgucguguucugcgggaccagcggcaccuacgggacgggcuccuggccggacggggccgacaucaaccugaugcccaucuga

SEQ ID NO: 24685 - RNA, 1410 nt, Artificial Sequence; identical to SEQ ID NO: 16442
  derived and/or modified CDS sequence (AUadapt) from InfluenzaA__AFJ77707__NA

SEQ ID NO: 24686 - RNA, 1410 nt, Artificial Sequence; identical to SEQ ID NO: 16463
  derived and/or modified CDS sequence (AUadapt) from InfluenzaA__AFJ77718__NA

SEQ ID NO: 24687 - RNA, 1410 nt, Artificial Sequence; identical to SEQ ID NO: 16463
  derived and/or modified CDS sequence (AUadapt) from InfluenzaA__AFJ77729__NA

SEQ ID NO: 24688 - RNA, 1410 nt, Artificial Sequence
  derived and/or modified CDS sequence (AUadapt) from InfluenzaA__AFJ77740__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggucguccagcuccugccacgacgggaaggccuggcuccacgugugcgugaccggcgacgacgagaacgcgaccgccucguucaucuacaacgggcgccugguggacuccaucgucagcugguccaagaagauccugcggacccaggagagcgagugcgugugcaucaacggcacgugcaucguggucaugaccgacggguccgccucgggcaaggccgacaccaagauccucuucaucgaggagggcaagaucgugcacaccagcacgcuguccgggucggcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcucgggccuggugggcgacacgccccgcaagaacgacuccagcuccucgucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaagcaggagaccgaggugcuguggaccuccaacagcaucgucguguucugcggcaccuccgggaccuacggcacggggagcuggccggacggcgccgacaucaaccugaugcccaucuga

SEQ ID NO: 24689 - RNA, 1410 nt, Artificial Sequence
  derived and/or modified CDS sequence (AUadapt) from InfluenzaA__AFJ77751__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccgcgaccggaccccguaccgcacccuccugaugaacgagcugggcgugcccuuccaccucgggacgcgccaggugugcaucgccugguccucguccagcugccacgacggcaaggcguggcugcacgucugcgugaccggggacgacaagaacgccaccgccuccuucaucuacaacggccggcugguggacucgaucggguccuggagcaagaagauccuccggacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgcuaccccggcgugcggugcgucugccgcgacaacuggaagggcuccaaccggccgaucguggacaucaacgugaaggacuacagcaucuucuccucguacgucugcuccgggcucgugggcgacacgccccgcaagaacgacagcuucuccucgucccacugccuggaccccaacaacgaggagggcgggcacggggugaagggcugggccuucgacgacggcaacgacgucuggauggggcggaccaucagcgagaagcugcgcuccggcuacgagaccuucaaggugaucgagggguggucgaagcccaacuccaagcuccagaucaaccggcaggucaucguggagcgcggcaaccggagcggguacuccggcaucuucucgguggagggcaaguccugcaucaaccgcugcuucuacgucgagcugauccgggggcgcaaggaggagaccgaggugugguggaccagcaacucgaucguggucuucugcggcaccuccgggaccuacggcacggggagcuggccggacggcgccgacaucaaccugaugcccaucuga

SEQ ID NO: 24690 - RNA, 1410 nt, Artificial Sequence; identical to SEQ ID NO: 16547
  derived and/or modified CDS sequence (AUadapt) from InfluenzaA__AFJ77762__NA

SEQ ID NO: 24691 - RNA, 1410 nt, Artificial Sequence; identical to SEQ ID NO: 16547
  derived and/or modified CDS sequence (AUadapt) from InfluenzaA__AFJ77773__NA

SEQ ID NO: 24692 - RNA, 1410 nt, Artificial Sequence; identical to SEQ ID NO: 16547
  derived and/or modified CDS sequence (AUadapt) from InfluenzaA__AFJ77784__NA

SEQ ID NO: 24693 - RNA, 1410 nt, Artificial Sequence; identical to SEQ ID NO: 17116
  derived and/or modified CDS sequence (AUadapt) from InfluenzaA__AFJ77795__NA

SEQ ID NO: 24694 - RNA, 1410 nt, Artificial Sequence; identical to SEQ ID NO: 17116
  derived and/or modified CDS sequence (AUadapt) from InfluenzaA__AFJ77806__NA

SEQ ID NO: 24695 - RNA, 1410 nt, Artificial Sequence; identical to SEQ ID NO: 17116
  derived and/or modified CDS sequence (AUadapt) from InfluenzaA__AFJ77817__NA

SEQ ID NO: 24696 - RNA, 1410 nt, Artificial Sequence; identical to SEQ ID NO: 17116
  derived and/or modified CDS sequence (AUadapt) from InfluenzaA__AFJ77828__NA

SEQ ID NO: 24697 - RNA, 1410 nt, Artificial Sequence
  derived and/or modified CDS sequence (AUadapt) from InfluenzaA__AFJ77839__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucauccacacgucgacccuguccgggagcgcgcagcacguggaggagugcuccugcuacccccgcuaccccggcgugcggugcgucugccgcgacaacuggaaggggucgaaccggccgaucguggacaucaacaucaaggacuacuccaucgugagcuccuacgucugcucgggccuggugggcgacacgccccgcaagaacgacuccagcuccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaaccccaacuccaagcugcagaucaaccggcaggucaucguggaccgcggcaaccggucgggguacuccggcaucuucagcguggagggcaagucgugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 24698 - RNA, 1410 nt, Artificial Sequence
  derived and/or modified CDS sequence (AUadapt) from InfluenzaA__AFJ77850__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccaaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 24699 - RNA, 1410 nt, Artificial Sequence; identical to SEQ ID NO: 17116
  derived and/or modified CDS sequence (AUadapt) from InfluenzaA__AFJ77861__NA

SEQ ID NO: 24700 - RNA, 1410 nt, Artificial Sequence; identical to SEQ ID NO: 17116
  derived and/or modified CDS sequence (AUadapt) from InfluenzaA__AFJ77872__NA

SEQ ID NO: 24701 - RNA, 1410 nt, Artificial Sequence; identical to SEQ ID NO: 17582
  derived and/or modified CDS sequence (AUadapt) from InfluenzaA__AFJ77883__NA

SEQ ID NO: 24702 - RNA, 1410 nt, Artificial Sequence; identical to SEQ ID NO: 17116
  derived and/or modified CDS sequence (AUadapt) from InfluenzaA__AFJ77894__NA

SEQ ID NO: 24703 - RNA, 1410 nt, Artificial Sequence; identical to SEQ ID NO: 17116
  derived and/or modified CDS sequence (AUadapt) from InfluenzaA__AFJ77905__NA

SEQ ID NO: 24704 - RNA, 1410 nt, Artificial Sequence
  derived and/or modified CDS sequence (AUadapt) from InfluenzaA__AFJ77916__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucaucgucuucugcggcaccuccgggacguacggcaccgggagcuggccggacggcgccgacaucaaccugaugcccaucuga

SEQ ID NO: 24705 - RNA, 1410 nt, Artificial Sequence; identical to SEQ ID NO: 17138
  derived and/or modified CDS sequence (AUadapt) from InfluenzaA__AFJ77927__NA

SEQ ID NO: 24706 - RNA, 1410 nt, Artificial Sequence; identical to SEQ ID NO: 17138
  derived and/or modified CDS sequence (AUadapt) from InfluenzaA__AFJ77938__NA

SEQ ID NO: 24707 - RNA, 1410 nt, Artificial Sequence; identical to SEQ ID NO: 17116
  derived and/or modified CDS sequence (AUadapt) from InfluenzaA__AFJ77949__NA

SEQ ID NO: 24708 - RNA, 1410 nt, Artificial Sequence; identical to SEQ ID NO: 17116
  derived and/or modified CDS sequence (AUadapt) from InfluenzaA__AFJ77960__NA

SEQ ID NO: 24709 - RNA, 1410 nt, Artificial Sequence
  derived and/or modified CDS sequence (AUadapt) from InfluenzaA__AFJ77971__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggacgagaccgaggugcuguggaccuccaacagcaucgucguguucugcggcaccuccgggacguacggcaccgggagcuggccggacggcgccgacaucaaccugaugcccaucuga

SEQ ID NO: 24710 - RNA, 1410 nt, Artificial Sequence
  derived and/or modified CDS sequence (AUadapt) from InfluenzaA__AFJ77982__NA
augaaccccaaccagaagaucaucaccaucggcuucgugucgcugaccaucuccacgaucugcuucuucaugcagaucgccauccucaucaccaccgucccgcugcacuucaagcaguacgaguucaacagcccgcccaacaaccaggugaugcugugcgagcccaccaucaucgagcgcaacaucacggagaucguguaccucaccaacaccaccaucgagaaggagaucugccccaagcuggccgaguaccggaacugguccaagccccagugcaacaucacgggguucgcgcccuucucgaaggacaacuccauccgccugagcgccggcggggacaucugggucacccgggagcccuacguguccugcgacccggacaagugcuaccaguucgcccucggccaggggaccacccugaacaacgugcacagcaacgacacgguccacgaccgcacccccuaccggacccugcucaugaacgagcugggcgugcccuuccaccugggcaccaagcaggucugcaucgccugguccucguccagcugccacgacgggaaggccuggcuccacgugugcgugacgggcgacgacaagaacgcgaccgccuccuucaucuacaacgggcgccugguggacagcaucgucuccuggucgaaggagauccugcggacccaggaguccgagugcgugugcaucaacgggaccugcacgguggucaugaccgacgggagcgccuccggcaaggccgacaccaagauccucuucaucgaggagggcaagaucgugcacaccucgacgcugagcggguccgcgcagcacguggaggagugcagcugcuacccccgcuacccgggcguccggugcgugugccgcgacaacuggaagggguccaaccggcccaucguggacaucaacaucaaggacuacucgaucgucuccagcuacgugugcuccggcaucgugggcgacacgccccgcaagaacgacagcuccucguccagccacugccuggaccccaacaacgaggagggcggccacggggucaagggcugggccuucgacgacgggaacgacguguggaugggccggaccaucuccgagaagcuccgcucgggcuacgagaccuucaaggucaucgaggggugguccaacccgaacagcaagcugcagaucaaccgccaggugaucguggaccggggcaaccgguccggguacagcggcaucuucuccgucgagggcaagucgugcaucaaccgcugcuucuacguggagcugauccgggggcgcaaggaggagaccgaggugcucuggaccagcaacuccaucgucguguucugcggcaccagcgggaccuacggcacgggguccuggcccgacggcgccgacaucaaccugaugcccaucuga

SEQ ID NO: 24711 - RNA, 1410 nt, Artificial Sequence; identical to SEQ ID NO: 17114
  derived and/or modified CDS sequence (AUadapt) from InfluenzaA__AFJ77993__NA

SEQ ID NO: 24712 - RNA, 1410 nt, Artificial Sequence
  derived and/or modified CDS sequence (AUadapt) from InfluenzaA__AFJ78004__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagaagaacaucaccgagaucguguaccucaccaacaccacgaucgagaaggagaucugccccaagcuggccgaguaccgcaacuggucgaagccgcagugcaacaucaccggguucgcgcccuucuccaaggacaacagcauccggcuguccgccggcggggacaucugggucacccgcgagcccuacgugucgugcgaccccgacaagugcuaccaguucgcccucggccaggggaccacgcugaacaacgugcacuccaacgacaccguccacgaccggaccccguaccgcacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcggcugguggacuccaucgucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaucaaggacuacuccaucgucagcuccuacgugugcucgggccuggugggcgacacgccccggaagaacgacuccagcuccagcucccacugccucgaccccaacaacgaggagggcgggcacggggucaagggcugggccuucgacgacgggaacgacguguggaugggccgcaccaucucggagaagcugcgguccggcuacgagaccuucaaggucaucgagggguggagcaaccccaacuccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 24713 - RNA, 1410 nt, Artificial Sequence; identical to SEQ ID NO: 17114
  derived and/or modified CDS sequence (AUadapt) from InfluenzaA__AFJ78015__NA

SEQ ID NO: 24714 - RNA, 1410 nt, Artificial Sequence; identical to SEQ ID NO: 23971
  derived and/or modified CDS sequence (AUadapt) from InfluenzaA__AFJ78026__NA

SEQ ID NO: 24715 - RNA, 1410 nt, Artificial Sequence; identical to SEQ ID NO: 23971
  derived and/or modified CDS sequence (AUadapt) from InfluenzaA__AFJ78037__NA

SEQ ID NO: 24716 - RNA, 1410 nt, Artificial Sequence
  derived and/or modified CDS sequence (AUadapt) from InfluenzaA__AFJ78048__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacgggaacgccuccggcaaggccgacaccaagauccucuucaucgaggagggcaagaucgugcacacgucgacccugagcggguccgcgcagcacguggaggagugcagcugcuacccccgcuaccccggcguccggugcgugugccgcgacaacuggaagggguccaaccggccgaucguggacaucaacaucaaggacuacucgaucgucuccagcuacgugugcuccggccuggugggcgacacgccccgcaagaacgacucguccagcuccucgcacugccucgaccccaacaacgaggagggcgggcacggggucaagggcugggccuucgacgacgggaacgacguguggaugggccggaccaucuccgagaagcugcgcagcggcuacgagaccuucaaggucaucgaggggugguccaaccccaacucgaagcugcagaucaaccgccaggugaucguggaccggggcaaccgguccggguacagcggcaucuucuccgucgagggcaagucgugcaucaaccgcugcuucuacguggagcucauccgggggcgcaaggaggagaccgaggugcuguggaccagcaacuccaucgucguguucugcggcaccagcgggacguacggcaccggguccuggccggacggcgccgacaucaaccugaugcccaucuga

SEQ ID NO: 24717 - RNA, 1410 nt, Artificial Sequence
  derived and/or modified CDS sequence (AUadapt) from InfluenzaA__AFJ78059__NA
augaaccccaaccagaagaucaucaccaucggcucggugucccugaccaucagcacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccccagugcaacaucaccggguucgcgcccuucucgaaggacaacuccauccgccugagcgccggcggggacaucugggucacccgggagcccuacguguccugcgacccggacaagugcuaccaguucgcccucggccaggggaccacgcugaacaacgugcacucgaacgacaccguccacgaccgcacccccuaccggacccugcucaugaacgagcugggcgugcccuuccaccugggcacgaagcaggucugcaucgccugguccagcuccucgugccacgacgggaaggccuggcuccacgugugcgugaccggcgacgacaagaacgcgaccgccuccuucaucuacaacgggcgccugguggacagcaucgucuccuggucgaaggagauccugcggacccaggaguccgagugcgugugcaucaacggcacgugcaccguggucaugaccgacgggagcgccuccggcaaggccgacaccaagauccucuucaucgaggagggcaagaucgugcacacgucgacccugagcggguccgcgcagcacguggaggagugcagcugcuacccccgcuacccgggcguccggugcgugugccgcgacaacuggaagggguccaaccggcccaucguggacaucaacaucaaggacuacucgaucgucuccagcuacgugugcuccggccuggugggcgacacgccccgcaagaacgacucguccagcuccucgcacugccucgaccccaacaacgaggagggcgggcacggggucaagggcugggccuucgacgacgggaacgacguguggaugggccggaccaucuccgagaagcugcgcagcggcuacgagaccuucaaggucaucgaggggugguccaacccgaacucgaagcugcagaucaaccgccaggugaucguggaccggggcaaccgguccggguacagcggcaucuucuccgucgagggcaagucgugcaucaaccgcugcuucuacguggagcucauccgggggcgcaaggacgagaccgaggugcuguggaccagcaacuccaucgucguguucugcggcaccagcgggacguacggcaccggguccuggcccgacggcgccgacaucaaccugaugcccaucuga

SEQ ID NO: 24718 - RNA, 1410 nt, Artificial Sequence
  derived and/or modified CDS sequence (AUadapt) from InfluenzaA__AFJ78070__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcggcugguggacuccaucgucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggacuacuccaucgucucguccuacgugugcagcggccuggugggcgacacgccccggaagaacgacuccucguccagcgggcacugccucgaccccaacaacgaggagggcgggcacggcgucaaggggugggccuucgacgacggcaacgacguguggaugggccgcaccaucuccgagaagucccggucgggguacgagaccuucaaggucaucgagggcuggagcaaccccaacuccaagcugcagaucaaccgccaggugaucguggaccgggggaaccgcucgggcuacuccgggaucuucagcgucgagggcaagucgugcaucaaccggugcuucuacguggagcugauccgcggccggaaggaggagaccgaggugcucuggaccuccaacagcaucgucguguucugcgggaccuccggcacguacgggaccggcagcuggccggacggggccgacaucaaccugaugcccaucuga

SEQ ID NO: 24719 - RNA, 1410 nt, Artificial Sequence
  derived and/or modified CDS sequence (AUadapt) from InfluenzaA__AFJ78081__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacaacuccucguccagccacugccucgaccccaacaacgaggagggcgggcacggggugaagggcugggccuucgacgacgggaacgacgucuggaugggccgcaccaucuccgagaagucccggcugggcuacgagaccuucaaggugaucgagggguggucgaaccccaacagcaagcugcagaugaaccgccaggucaucguggaccggggcaaccgcuccggguacucgggcaucuucuccguggagggcaagagcugcaucaaccggugcuucuacgucgagcucauccgcgggcggaaggaggagaccgaggugcuguggaccucgaacuccaucguggucuucugcggcaccagcgggacguacggcaccggguccuggccggacggcgccgacaucaaccugaugcccaucuga

SEQ ID NO: 24720 - RNA, 1410 nt, Artificial Sequence; identical to SEQ ID NO: 24636
  derived and/or modified CDS sequence (AUadapt) from InfluenzaA__AFJ78092__NA

SEQ ID NO: 24721 - RNA, 1410 nt, Artificial Sequence
  derived and/or modified CDS sequence (AUadapt) from InfluenzaA__AFJ78103__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccugcugggguccgcgcagcacguggaggagugcagcugcuacccccgguaccccggcgugcgcugcgucugccgggacaacuggaagggguccaaccgcccgaucguggacaucaacaucaaggaccacucgaucguguccagcuacgucugcuccggccucgugggcgacacgccccggaagaacgacucguccagcuccgggcacugccuggaccccaacaacgaggagggcgggcacggcgugaaggggugggccuucgacgacggcaacgacgucuggaugggccgcaccaucucggagaagucccggcugggguacgagaccuucaaggugaucgagggcuggagcaaccccuccucgaagcuccagaucaaccgccaggucaucguggaccgggggaaccgcuccggcuacagcgggaucuucuccguggagggcaagucgugcaucaaccggugcuucuacgucgagcugauccgcggccggaaggaggagaccgaggugcuguggaccagcaacuccaucguggucuucugcgggaccagcggcacguacgggaccggcuccuggccggacggggccgacaucaaccucaugcccaucuga

SEQ ID NO: 24722 - RNA, 1410 nt, Artificial Sequence
  derived and/or modified CDS sequence (AUadapt) from InfluenzaA__AFJ78114__NA
augaaccccaaccagaagaucaucaccaucggcucggugucccugaccaucagcacgaucugcuucuucaugcagaucgccauccucaucaccaccgucacccugcacuucaagcaguacgagcugaacuccccgcccaacaaccaggugaugcucugcgagcccacgaucaucgagcgcaacaucaccgagaucguguaccugaccaacaccacgaucgagaaggagaucugccccaagcuggccgaguaccggaacuggucgaagccgcagugcgacaucaccggguucgcgcccuucuccaaggacaacagcauccgccucuccgccggcggggacaucugggucacccgggagcccuacgugucgugcgaccccgacaagugcuaccaguucgcccugggccaggggaccacgcugaacaacgugcacuccaacgacaccguccgcgaccggaccccguaccgcacccuccugaugaacgagcugggcgugcccuuccaccucggcacgaagcaggucugcaucgccuggagcuccucguccugccacgacgggaaggccuggcugcacgugugcaucaccggcgacgacaagaacgcgaccgccagcuucaucuacaacgggcggcugguggacuccaucgugucgugguccaaggagauccuccgcacccaggagagcgagugcgucugcaucaacggcacgugcaccguggugaugaccgacggguccgccucgggcaaggccgacaccaagauccuguucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccucgugggcgacacgccccggaagaacgacuccucguccagcucccacugccuggaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaacuccaagcuccagaucaaccgccaggucaucguggaccggucgaaccgcuccggcuacagcgggaucuucucgguggagggcaaguccugcaucaaccggugcuucuacgucgagcugauccgcgggcggaaggaggagaccgaggugcuguggaccagcaacuccaucguggucuucugcggcaccagcggcacguacgggaccggcuccuggccggacggggccgacaucaaccucaugcccaucuga

SEQ ID NO: 24723 - RNA, 1410 nt, Artificial Sequence
  derived and/or modified CDS sequence (AUadapt) from InfluenzaA__AFJ78125__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaugugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaacuccaagcugcagaugaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 24724 - RNA, 1410 nt, Artificial Sequence
  derived and/or modified CDS sequence (AUadapt) from InfluenzaA__AFJ78136__NA
augaaccccaaccagaagaucaucaccaucggcucggugucccugaccaucucgacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggucguccagcuccugccacgacgggaaggccuggcuccacgugugcaucaccggcgacgacaagaacgcgaccgccucguucaucuacaacgggcggcugguggacuccaucgugagcugguccaaggagauccugcgcacgcaggagucggagugcgucugcaucaacgggaccugcaccguggugaugaccgacggguccgccagcggcaaggccgacacgaagauccucuucaucgaggagggcaagaucguccacaccucgacccuguccgggagcgcgcagcacguggaggagugcuccugcuacccccgguaccccggcgugcgcugcgucugccgggacaacuggaaggggucgaaccgcccgaucguggacaucaacaucaaggaccacuccaucgugagcuccuacgucugcucgggccuggugggcgacacgccccggaagaacgacuccagcuccucgucccacugccucgaccccaacaacgaggagggcggccacggggugaagggcugggccuucgacgacgggaacgacgucuggaugggccgcaccaucagcgagaagucccggcugggcuacgagaccuucaaggugaucgagggguggucgaaccccaaguccaagcugcagaucaaccgccaggucaucguggaccggggcaaccgcagcggguacuccggcaucuucucgguggagggcaagagcugcaucaaccggugcuucuacgucgagcucauccgcgggcggaaggaggagaccgaggugcuguggaccuccaacucgaucguggucuucugcggcacguccgggaccuacggcaccgggagcuggccggacggcgccgacaucaaccugaugcccaucuga

SEQ ID NO: 24725 - RNA, 1410 nt, Artificial Sequence; identical to SEQ ID NO: 24724
  derived and/or modified CDS sequence (AUadapt) from InfluenzaA__AFJ78147__NA

SEQ ID NO: 24726 - RNA, 1410 nt, Artificial Sequence; identical to SEQ ID NO: 24724
  derived and/or modified CDS sequence (AUadapt) from InfluenzaA__AFJ78158__NA

SEQ ID NO: 24727 - RNA, 1410 nt, Artificial Sequence; identical to SEQ ID NO: 18286
  derived and/or modified CDS sequence (AUadapt) from InfluenzaA__AFJ78169__NA

SEQ ID NO: 24728 - RNA, 1410 nt, Artificial Sequence; identical to SEQ ID NO: 18804
  derived and/or modified CDS sequence (AUadapt) from InfluenzaA__AFJ78180__NA

SEQ ID NO: 24729 - RNA, 1410 nt, Artificial Sequence; identical to SEQ ID NO: 18286
  derived and/or modified CDS sequence (AUadapt) from InfluenzaA__AFJ78191__NA

SEQ ID NO: 24730 - RNA, 1410 nt, Artificial Sequence
  derived and/or modified CDS sequence (AUadapt) from InfluenzaA__AFJ78202__NA
augaaccccaaccagaagaucaucaccaucggcucggugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaucaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggggcgcgcagcacguggaggagugcucgugcuacccccgguaccccggggugcgcugcgucugccgggacaacuggaagggcuccaaccgcccgaucguggacaucaacaucaaggaccacagcaucguguccucguacgucugcuccggccuggugggggacacgccccggaagaacgacagcuccucguccagccacugccucgaccccaacaacgaggagggcgggcacggcgugaaggggugggccuucgacgacggcaacgacgucuggaugggccgcaccaucuccgagaagucccggcugggguacgagaccuucaaggugaucgagggcuggucgaaccccaagagcaagcugcagaucaaccgccaggucaucguggaccgggggaaccgcuccggcuacucggggaucuucuccguggagggcaagagcugcaucaaccggugcuucuacgucgagcucauccgcggccggaaggaggagaccgaggugcuguggaccucgaacuccaucguggucuucugcgggaccagcggcacguacgggaccggcuccuggccggacggggccgacaucagccugaugcccaucuga

SEQ ID NO: 24731 - RNA, 1410 nt, Artificial Sequence
  derived and/or modified CDS sequence (AUadapt) from InfluenzaA__AFJ78213__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugagcugguccaaggagauccugcgcacccaggagucggagugcgucugcaucaacggcacgugcaccguggugaugaccgacggguccgccagcggcaaggccgacaccaagauccucuucaucgaggagggcaagaucguccacacgucgacccuguccgggagcgcgcagcacguggaggagugcuccugcuacccccgguaccccggcgugcgcugcgucugccgggacaacuggaaggggucgaaccgcccgaucguggacaucaacaucaaggaccacuccaucgugagcuccuacgucugcucgggccuggugggcgacacgccccggaagaacgacuccagcuccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcucaucuga

SEQ ID NO: 24732 - RNA, 1410 nt, Artificial Sequence; identical to SEQ ID NO: 18286
  derived and/or modified CDS sequence (AUadapt) from InfluenzaA__AFJ78224__NA

SEQ ID NO: 24733 - RNA, 1410 nt, Artificial Sequence; identical to SEQ ID NO: 18286
  derived and/or modified CDS sequence (AUadapt) from InfluenzaA__AFJ78235__NA

SEQ ID NO: 24734 - RNA, 1410 nt, Artificial Sequence
  derived and/or modified CDS sequence (AUadapt) from InfluenzaA__AFJ78246__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggccaugcugugcgagcccacgaucaucgagcgcaacaucaccgagaucguguaccucaccaacaccacgaucgagaaggagaucugccccaagcuggcggaguaccggaacuggagcaagccgcagugcgacaucaccggguucgcccccuucuccaaggacaacucgauccgccuguccgccggcggggacaucugggugacccgggagcccuacgucagcugcgaccccgacaagugcuaccaguucgcccucggccaggggaccacgcugaacaacgugcacuccaacgacaccgugcgcgaccggaccccguaccgcacccugcucaugaacgagcugggcguccccuuccaccugggcacgaagcaggucugcaucgccuggucguccagcuccugccacgacgggaaggcguggcuccacgugugcaucaccggcgacgacaagaacgccaccgccucguucaucuacaacgggcggcugguggacuccaucgugagcugguccaaggagauccugcgcacccaggagucggagugcgugugcaucaacggcacgugcaccgucgugaugaccgacggguccgccagcggcaaggcggacaccaagauccucuucaucgaggagggcaagaucgugcacacgucgacccuguccgggagcgcccagcacgucgaggagugcuccugcuacccccgguaccccggcgugcgcugcgugugccgggacaacuggaaggggucgaaccgcccgaucgucgacaucaacaucaaggaccacuccaucgugagcuccuacgugugcucgggccuggucggcgacacgccccggaagaacgacuccagcuccucgucccacugccucgaccccaacaacgaggagggcgggcacggggugaagggcugggccuucgacgacgggaacgacguguggaugggccgcaccaucagcgagaagucccggcugggcuacgagaccuucaaggucaucgagggguggucgaaccccaaguccaagcugcagaucaaccgccaggugaucgucgaccggggcaaccgcagcggguacuccggcaucuucucgguggagggcaagagcugcaucaaccggugcuucuacguggagcucauccgcgggcggaaggaggagaccgagguccuguggaccuccaacucgaucgugguguucugcggcaccuccgggacguacggcaccgggagcuggccggacggcgccgacaucaaccugaugcccaucuga

SEQ ID NO: 24735 - RNA, 1410 nt, Artificial Sequence
  derived and/or modified CDS sequence (AUadapt) from InfluenzaA__AFJ78268__NA
augaaccccaaccagaagaucaucaccaucggcucggugucccugaccaucucgacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggucguccagcuccugccacgacgggaaggccuggcuccacgugugcaucaccggcgacgacaagaacgcgaccgccucguucaucuacaacgggcggcugguggacuccaucgugagcugguccaaggagauccugcgcacgcaggagucggagugcgucugcaucaacgggaccugcaccguggugaugaccgacggguccgccagcggcaaggccgacacgaagauccucuucaucgaggagggcaagaucguccacaccucgaagcuguccgggagcgcgcagcacguggaggagugcuccugcuacccccgguaccccggcgugcgcugcgucugccgggacaacuggaaggggucgaaccgcccgaucguggacaucaacaugaaggaccacuccaucgugagcuccuacgucugcucgggccuggugggcgacacgccccggaagaacgacuccagcuccucgucccacugccucgaccccaacaacgaggagggcggccacggggugaagggcugggccuucgacgacgggaacgacgucuggaugggccgcaccaucagcgagaagucccggcugggcuacgagaccuucaaggugaucgagggguggucgaaccccaaguccaagcugcagaucaaccgccaggucaucguggaccggggcaaccgcagcggguacuccggcaucuucucgguggagggcaagagcugcaucaaccggugcuucuacgucgagcucauccgcgggcggaaggaggagaccgaggugcuguggaccuccaacucgaucguggucuucugcggcaccuccgggacguacggcaccgggagcuggccggacggcgccgacaucaaccugaugcccaucuga

SEQ ID NO: 24736 - RNA, 1410 nt, Artificial Sequence
  derived and/or modified CDS sequence (AUadapt) from InfluenzaA__AFJ78279__NA
augaaccccaaccagaagaucaucaccaucggcucggugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaucaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggggcgcgcagcacguggaggagugcucgugcuacccccgguaccccggggugcgcugcgucugccgggacaacuggaagggcuccaaccgcccgaucguggacaucaacaucaaggaccacagcaucguguccucguacgucugcuccggccuggugggggacacgccccggaagaacgacagcuccucguccagccacugccucgaccccaacaacgaggagggcgggcacggcgugaaggggugggccuucgacgacggcaacgacgucuggaugggccgcaccaucuccgagaagucccggcugggguacgagaccuucaaggugaucgagggcuggucgaaccccaagagcaagcugcagaucaaccgccaggucaucguggaccgggggaaccgcuccggcuacucggggaucuucuccguggagggcaagagcugcaucaaccggugcuucuacgucgagcucauccgcggccggaaggaggagaccgaggugcuguggaccucgaacuccaucguggucuucugcgggaccagcggcacguacgggaccggcuccuggccggacggggccgacaucaaccugaugcccaucuga

SEQ ID NO: 24737 - RNA, 1410 nt, Artificial Sequence
  derived and/or modified CDS sequence (AUadapt) from InfluenzaA__AFJ78290__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcgcgcuguccgggucggcccagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggaccuacggcacggggagcuggccggacggcgccgacaucaaccugaugcccaucuga

SEQ ID NO: 24738 - RNA, 1413 nt, Artificial Sequence
  derived and/or modified CDS sequence (AUadapt) from InfluenzaA__AFJ78312__NA
augaaccccaaccagaagaucaucaccaucggcucgaucuccaucgccaucgggaucaucucgcugaugcuccagaucggcaacaucaucuccaucugggccagccacuccauccagaccgggucgcagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccucgccguacaacagcaaguucgaguccguggccuggucggccuccgccugccacgacggcaugggcuggcucaccaucgggaucagcggccccgacaacggggcgguggccguccugaaguacaacggcaucaucacggagaccaucaaguccugggagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacucccacuacgaggagugcagcugcuacccggacaccggcaccgugaugugcgugugccgcgacaacuggcacggguccaaccggcccugggucucguucaaccagaaccuggacuaccagaucggcuacaucugcuccggcguguucggggacaacccccgccccaaggacggcgaggggucgugcaacccggugacggcggacggcgccgacggggucaagggcuucuccuacaaguacggcaacgggguguggaucggccggaccaagagcaaccgccugcggaagggguucgagaugaucugggaccccaacggcuggaccgacaccgacuccgacuucucggugaagcaggacgucguggccaucacggacuggagcggguacuccggcucguucgugcagcaccccgagcucaccggccuggacugcauccgccccugcuucugggucgagcuggugcgggggcgcccgcgggagaacaccaccaucuggacguccggcagcuccaucucguucugcggggucaacuccgacaccgccaacuggagcuggcccgacggcgccgagcuccccuucaccaucgacaaguga

SEQ ID NO: 24739 - RNA, 1410 nt, Artificial Sequence; identical to SEQ ID NO: 24671
  derived and/or modified CDS sequence (AUadapt) from InfluenzaA__AFJ78323__NA

SEQ ID NO: 24740 - RNA, 1413 nt, Artificial Sequence
  derived and/or modified CDS sequence (AUadapt) from InfluenzaA__AFJ78334__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcucgggcguguucggggacaacccccggcccaaggacggcgagggguccugcaacccggugacggucgacggcgcggacggggugaagggcuucagcuacaaguacggcaacgggguguggaucggccgcaccaaguccaaccggcugcgcaagggguucgagaugaucugggaccccaacggcuggaccgacaccgacagcgacuucuccgucaagcaggacgugguggccaucacggacuggucgggguacagcggcuccuucguccagcaccccgagcucaccggccuggacugcauccggcccugcuucuggguggagcugguccgcgggcucccgcgggagaacaccaccaucuggacgucgggcuccagcaucuccuucugcggggugaacagcgacaccgccaacugguccuggcccgacggcgccgagcugcccuucaccaucgacaaguga

SEQ ID NO: 24741 - RNA, 1413 nt, Artificial Sequence; identical to SEQ ID NO: 24740
  derived and/or modified CDS sequence (AUadapt) from InfluenzaA__AFJ78345__NA

SEQ ID NO: 24742 - RNA, 1413 nt, Artificial Sequence
  derived and/or modified CDS sequence (AUadapt) from InfluenzaA__AFJ78356__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggucgggaaggacaagaccagcgugacccuggcgggcaacuccucgcugugcuccaucagcggcugggccaucuacaccaaggacaacuccauccggaucgggucgaagggcgacguguucgucauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcccccucgccguacaacagcaaguucgaguccguggcguggagcgccuccgccugccacgacggcaugggcuggcucaccaucgggaucucgggccccgacaacggggccgucgcggugcugaaguacaacggcaucaucacggagaccaucaaguccuggaagaagcagauccugcgcacccaggagagcgagugcgugugcgucaacggcuccugcuucaccaucaugacggacgggcccucgaacggcgccgccuccuacaagaucuucaagaucgagaaggggaaggugaccaagagcaucgagcucaacgcccccaacuuccacuacgaggagugcuccugcuacccggacaccggcaccgugaugugcaucugccgggacaacuggcacgggagcaaccgccccugggucuccuucaaccagaaccuggacuaccagaucggcuacaucugcucgggcguguucggggacaacccccggcccaaggacggcgagggguccugcaacccggugacggucgacggcgccgacggggugaagggcuucagcuacaaguacggcaacgggguguggaucggccgcaccaaguccaaccggcugcgcaagggguucgagaugaucugggaccccaacggcuggaccgacaccgacucggacuucuccgucaagcaggacgugguggcgaucacggacuggagcggguacagcggcuccuucguccagcaccccgagcucaccggccuggacugcauccggcccugcuucuggguggagcugguccgcgggcucccgcgggagaacaccaccaucuggacgucgggcuccagcaucuccuucugcggggugaacagcgacaccgccaacugguccuggcccgacggcgccgagcugcccuucaccaucgacaaguga

SEQ ID NO: 24743 - RNA, 1413 nt, Artificial Sequence
  derived and/or modified CDS sequence (AUadapt) from InfluenzaA__AFJ78367__NA
augaaccccaaccagaagaucaucaccaucggcucgaucuccaucgccaucgggaucaucucgcugaugcuccagaucggcaacaucaucuccaucugggccagccacuccauccagaccgggucgcagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccucgcugugcuccaucucgggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggucggccuccgccugccacgacggcaugggcuggcucaccaucgggaucucgggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccucgaacggcgccgccuccuacaagaucuucaagaucgagaaggggaaggucaccaagagcaucgagcucaacgcccccaacucccacuacgaggagugcucgugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcgaggggucgugcaacccggugacggcggacggcgccgacggggucaagggcuucuccuacaaguacggcaacgggguguggaucggccggaccaagucgaaccgccugcggaagggguucgagaugaucugggaccccaacggcuggaccgacaccgacuccgacuucagcgugaagcaggacgucguggccaucacggacuggucgggguacuccggcagcuucgugcagcaccccgagcucaccggccuggacugcauccgccccugcuucugggucgagcuggugcgggggcgcccgcgggagaacaccaccaucuggacguccggcucguccaucagcuucugcggggucaacggcgacaccgccaacugguccuggcccgacggcgccgagcuccccuucaccaucgacaaguga

SEQ ID NO: 24744 - RNA, 1413 nt, Artificial Sequence
  derived and/or modified CDS sequence (AUadapt) from InfluenzaA__AFJ78378__NA
augaaccccaaccagaaggugaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggucaaccacaccuacgugaacaucaacaacacgaacguggucgcggggaaggacaagaccucggugacccuggccggcaacuccagccugugcuccaucucgggcugggccaucuacaccaaggacaacuccauccggaucgggagcaagggcgacguguucgucauccgcgagccguucaucuccugcucgcacauggagugccggacguucuuccucacccagggggcccugcugaacgacaagcacuccaacggcaccgugaaggaccgcagccccuaccgggcccucauguccugcccccugggggaggcgcccucgccguacaacagcaaguucgaguccguggccuggucggccuccgccugccacgacggcaugggcuggcugaccaucgggaucagcggccccgacaacggggcggucgccgugcucaaguacaacggcaucaucacggagaccaucaaguccuggaagaagcgcauccugcggacccaggagucggagugcgugugcgucaacggcuccugcuucaccaucaugacggacgggcccagcaacggcgccgccuccuacaagaucuucaagaucgagaaggggaaggugaccaagucgaucgagcugaacgcccccaacucccacuacgaggagugcagcugcuacccggacaccggcaccgugaugugcgucugccgcgacaacuggcacggguccaaccggcccugggugucguucaaccagaaccucgacuaccagaucggcuacaucugcuccggcguguucggggacaacccccgcccccgggacggcgaggggagcugcaacccggucacgguggacggcgcggacggggugaagggcuucuccuacaaguacggcaacggggucuggaucggccgcaccaagucgaaccggcugcgcaagggguucgagaugaucugggaccccaacggcuggaccgacaccgacuccgacuucgccgugaagcaggacguggucgccaucacggacuggagcggguacucgggcuccuucgugcagcaccccgagcugaccggccucgacugcauccggcccugcuucugggucgagcuggugcgcgggcugccgcgggagaacaccaccaucuggacgagcggcuccucgaucuccuucugcggggugaacagcgacaccgccaacugguccuggcccgacggcgccgagcuccccuucaccaucgacaaguga

SEQ ID NO: 24745 - RNA, 1413 nt, Artificial Sequence; identical to SEQ ID NO: 16788
  derived and/or modified CDS sequence (AUadapt) from InfluenzaA__AFJ78389__NA

SEQ ID NO: 24746 - RNA, 1413 nt, Artificial Sequence; identical to SEQ ID NO: 16788
  derived and/or modified CDS sequence (AUadapt) from InfluenzaA__AFJ78400__NA

SEQ ID NO: 24747 - RNA, 1413 nt, Artificial Sequence; identical to SEQ ID NO: 16788
  derived and/or modified CDS sequence (AUadapt) from InfluenzaA__AFJ78411__NA

SEQ ID NO: 24748 - RNA, 1413 nt, Artificial Sequence
  derived and/or modified CDS sequence (AUadapt) from InfluenzaA__AFJ78422__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucucgggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaccggcuggcucacgaucgggaucucgggccccgacaacggggcgguggccguccugaaguacaacggcaucaucaccgagaccaucaaguccuggaagaagcgcauccugcggacccaggagagcgagugcgugugcaugaacggcuccugcuucacgaucaugaccgacgggcccucgaacggcgccgccuccuacaagaucuucaagaucgagaaggggaaggugaccaagagcaucgagcucaacgcccccuccuuccacuacgaggagugcagcugcuacccggacaccggcacggucaugugcgugugccgcgacaacuggcacggguccaaccggcccugggugucguucaaccagaaccuggacuaccagaucggcuacaucugcuccggcgucuucggggacaacccccgcccccaggacggcgaggggagcugcaacccggugaccguggacggcgcggacggggucaagggcuucuccuacaaguacggcaacgggguguggaucggccggaccaagucgaaccgccugcggaagggguucgagaugaucugggaccccaacggcuggaccaacacggacuccgacuucagcgugaagcaggacgucguggccaucaccgacuggucgggguacuccggcagcuucgugcagcaccccgagcucaccggccuggacugcauccgccccugcuucugggucgagcuggugcgggggcucccgcgcgagaacaccacgaucuggaccuccggcucguccaucagcuucugcggggucaacuccgacaccgccaacuggagcuggcccgacggcgccgagcugcccuucaccaucgacaaguga

SEQ ID NO: 24749 - RNA, 1413 nt, Artificial Sequence; identical to SEQ ID NO: 18895
  derived and/or modified CDS sequence (AUadapt) from InfluenzaA__AFJ78433__NA

SEQ ID NO: 24750 - RNA, 1413 nt, Artificial Sequence; identical to SEQ ID NO: 18895
  derived and/or modified CDS sequence (AUadapt) from InfluenzaA__AFJ78444__NA

SEQ ID NO: 24751 - RNA, 1413 nt, Artificial Sequence
  derived and/or modified CDS sequence (AUadapt) from InfluenzaA__AFJ78466__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucucgggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaucggcuggcucaccaucgggaucucgggccccgacaacggggcgguggccguccugaaguacaacggcaucaucacgggcaccaucaaguccuggaagaagcagauccugcgcacccaggagagcgagugcgugugcaucaacggguccugcuucaccaucaugacggacggccccucgaacggggccgccuccuacaagaucuucaagaucgagaagggcaaggugaccaagagcaucgagcucaacgcccccaacuuccacuacgaggagugcuccugcuacccggacaccgggaccgucaugugcgugugccgggacaacuggcacggcucgaaccgccccuggguguccuucaaccagaaccuggacuaccagaucggcuacaucugcagcggggucuucggcgacaacccccggcccaaggacggggagggccgcugcaacccggugacgguggacggggcggacggcgucaagggcuucuccuacaaguacgggaacggcguguggaucgggcggaccaagucgaaccgccugcggaagggcuucgagaugaucugggaccccaacggguggaccaacaccgacuccgacuucagcgugaagcaggacgucguggccaucacggacugguccggcuacucgggcagcuucgugcagcaccccgagcucaccgggcuggacugcauccgccccugcuucugggucgagcuggugcggggccucccgcgcgagaacaccaccaucuggacguccgggucguccaucagcuucugcggcgucaacuccgacaccgccaacuggagcuggcccgacggcgccgagcugcccuucaccaucgacaaguga

SEQ ID NO: 24752 - RNA, 1413 nt, Artificial Sequence
  derived and/or modified CDS sequence (AUadapt) from InfluenzaA__AFJ78477__NA
augaaccccaaccagaagaucaucaccaucggcucgaucuccaucgccaucgggaucaucggccugaugcuccagaucgggaacaucaucagcaucugggccucccacucgauccagaccggcucccagaaccacacggggaucugcagccagcgcaucaucaccuacgagaacuccaccugggugaacaacaccuacgucaacaucaacaacacgaacgugguggcggagaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgcgcuucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcggauccugcgcacccaggagucggagugcgugugcaugaacggcuccugcuucaccaucaugacggacgggcccagcaacggcgccgccuccuacaagaucuucaagaucgagaaggggaaggugaccaagucgaucgagcucaacgcccccaacuuccacuacgaggagugcuccugcuacccggacaccggcaccgucaugugcgugugccgggacaacuggcacgggagcaaccgccccuggguguccuucaaccagaaccuggacuaccagaucggcuacaucugcucgggcgucuucggggacaacccccggcccaaggacggcgagggguccugcaacccggugacgguggacggcgcggacggggucaagggcuucagcuacaaguacggcaacgggguguggaucggccgcaccaaguccaaccggcugcgcaagggguucgagaugaucugggaccccaacggcuggaccaacaccgacagcgacuucuccgugaagcaggacgucguggccaucacggacuggucgggguacagcggcuccuucgugcagcaccccgagcucaccggccuggacugcauccggcccugcuucugggucgagcuggugcgcgggcucccgcgggagaacaccaccaucuggacgucgggcuccagcaucuccuucugcggggucaacagcggcaccgccaacugguccuggcccgacggcgccgagcugcccuucaccaucgacaaguga

SEQ ID NO: 24753 - RNA, 1413 nt, Artificial Sequence
  derived and/or modified CDS sequence (AUadapt) from InfluenzaA__AFJ78488__NA
augaaccccaaccagaagaucaucaccaucggcucgaucuccaucgccaucgggaucaucagccugauccuccagaucggcaacaucaucuccaucugggccucgcacuccauccagaccgggagccagaaccacacgggcaucugcaaccagcgcaucaucaccuacgagaacuccaccugggugaacaacaccuacgucaacaucaacaacacgaacgugguggcggagaaggacaagaccucggucacccuggccgggaacuccagccugugcuccaucucgggcugggccaucuacaccaaggacaacuccauccggaucggcagcaagggggacguguucgugauccgcgagccguucaucuccugcucgcaccucgagugccggacguucuuccugacccagggcgcccugcucaacgacaagcacuccaacgggaccgucaaggaccgcagccccuaccgggcccugauguccugcccccugggcgaggcgcccucgccguacaacagccgcuucgaguccguggccuggagcgccuccgccugccacgacgggaugggcuggcucaccaucggcaucucggggcccgacaacggcgcgguggccguccugaaguacaacgggaucaucacggagaccaucaaguccuggaagaagcggauccugcgcacccaggagagcgagugcgugugcaugaacggcuccugcuucaccaucaugacggacggccccucgaacggggccgccuccuacaagaucuucaagaucgagaagggcaaggugaccaagaccaucgagcucaacgcccccaacuuccacuacgaggagugcagcugcuacccggacaccgggacggucaugugcgugugccgggacaacuggcacggcuccaaccgccccugggugucguucaaccagaaccuggacuaccagaucggguacaucugcuccggcgucuucggcgacaacccccggcccaaggacggggagggcagcugcaacccggugaccguggacggggcggacggcgucaagggguucuccuacaaguacggcaacggcguguggaucgggcgcaccaagucgaaccggcugcgcaagggcuucgagaugaucugggaccccaacggguggaccaacacggacuccgacuucagcaugaagcaggacguggucgccaucaccgacugguccggcuacucggggagcuucgugcagcaccccgagcucaccggccuggacugcauccggcccugcuucuggguggagcugguccgcggccucccgcgggagaacaccacgaucuggaccuccgggucguccaucagcuucugcggcgugaacuccgggaccgccaacuggagcuggcccgacggcgccgagcugcccuucaccaucgacaaguga

SEQ ID NO: 24754 - RNA, 1413 nt, Artificial Sequence
  derived and/or modified CDS sequence (AUadapt) from InfluenzaA__AFJ78510__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacggggccgccuccuacaagaucuucaagaucgagaagggcaaggugaccaagagcaucgagcucaacgcccccaacuuccacuacgaggagugcuccugcuacccggacaccgggaucgucaugugcgugugccgggacaacuggcacggcagcaaccgccccuggguguccuucaaccagaaccuggacuaccagaucggcuacaucugcucgggggucuucggcgacaacccccggcccaaggacggggagggcuccugcaacccggugaccguggacggggcggacggcgucaagggcuucagcuacaaguacgacaacgggguguggaucggccgcacgaaguccaaccggcugcgcaagggguucgagaugaucugggaccccaacggcuggaccaacaccgacucggacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccucgggcuccagcaucuccuucugcggggucaacagcgacacggccaacugguccuggcccgacggcgccgagcugcccuucaccaucgacaaguga

SEQ ID NO: 24755 - RNA, 1413 nt, Artificial Sequence
  derived and/or modified CDS sequence (AUadapt) from InfluenzaA__AFJ78521__NA
augaaccccaaccagaagaucaucaccaucggcucgaucuccaucgccaucgggaucaucagccugauccuccagaucggcaacaucaucuccaucugggccucgcacuccauccagaccgggagccagaaccacacgggcaucugcaaccagcgcaucaucaccuacgagaacuccaccugggugaacaacaccuacgucaacaucaacaacacgaacgugguggcggagaaggacaagaccucggucacccuggccgggaacuccagccugugcuccaucucgggcugggccaucuacaccaaggacaacuccauccggaucggcagcaagggggacguguucgugauccgcgagccguucaucuccugcucgcaccucgagugccggacguucuuccugacccagggcgcccugcucaacgacaagcacuccaacgggaccgucaaggaccgcagccccuaccgggcccugauguccugcccccugggcgaggcgcccucgccguacaacagccgcuucgaguccguggccuggagcgccuccgccugccacgacgggaugggcuggcucaccaucggcaucucggggcccgacaacggcgcgguggccguccugaaguacaacgggaucaucacggagaccaucaaguccuggaagaagcggauccugcgcacccaggagagcgagugcgugugcaugaacggcuccugcuucaccaucaugacggacggccccucgaacggggccgccuccuacaagaucuucaagaucgagaagggcaaggugaccaagaccaucgagcucaacgcccccaacuuccacuacgaggagugcagcugcuacccggacaccgggacggucaugugcgugugccgggacaacuggcacggcuccaaccgccccugggugucguucaaccagaaccuggacuaccagaucggguacaucugcuccggcgucuucggcgacaacccccggcccaaggacggggagggcagcugcaacccggugaccguggacggggcggacggcgucaagggguucuccuacaaguacggcaacggcguguggaucgggcgcaccaagucgaaccggcugcgcaagggcuucgagaugaucugggaccccaacggguggaccaacacggacuccgacuucagcgugaagcaggacgucguggccaucaccgacugguccggcuacucggggagcuucgugcagcaccccgagcucaccggccuggacugcauccggcccugcuucugggucgagcuggugcgcggccucccgcgggagaacaccacgaucuggaccuccgggucguccaucagcuucugcggcgucaacuccgggaccgccaacuggagcuggcccgacggcgccgagcugcccuucaccaucgacaaguga

SEQ ID NO: 24756 - RNA, 1413 nt, Artificial Sequence; identical to SEQ ID NO: 24649
  derived and/or modified CDS sequence (AUadapt) from InfluenzaA__AFJ78532__NA

SEQ ID NO: 24757 - RNA, 1413 nt, Artificial Sequence; identical to SEQ ID NO: 24649
  derived and/or modified CDS sequence (AUadapt) from InfluenzaA__AFJ78543__NA

SEQ ID NO: 24758 - RNA, 1413 nt, Artificial Sequence; identical to SEQ ID NO: 24649
  derived and/or modified CDS sequence (AUadapt) from InfluenzaA__AFJ78554__NA

SEQ ID NO: 24759 - RNA, 1413 nt, Artificial Sequence; identical to SEQ ID NO: 24637
  derived and/or modified CDS sequence (AUadapt) from InfluenzaA__AFJ78565__NA

SEQ ID NO: 24760 - RNA, 1413 nt, Artificial Sequence
  derived and/or modified CDS sequence (AUadapt) from InfluenzaA__AFJ78576__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccccggucacccuggccggcaacucgucccugugcagcaucuccggcugggccauccacaccaaggacaacucgauccggaucggguccaagggcgacguguucgugauccgcgagcccuucaucagcugcucccaccucgagugcaagacguucuuccugacccagggggcccugcucaacgacaagcacucgaacggcaccgucaaggaccggucccccuaccgcgcccugaugagcugcccccugggggaggcgccgucccccuacaacucgaaguucgagagcguggccugguccgccucggccugccacgacggcaucggcuggcucaccaucgggaucuccggccccgacaacggggcgguggccguccugaaguacaacggcaucaucacgggcaccaucaagagcuggaagaagcagauccugcggacccaggaguccgagugcgugugcaugaacgggucgugcuucaccaucaugacggacggccccuccaacggggccgccagcuacaagaucuucaagaucgagaagggcaaggugaccaaguccauggagcucaacgccccgaacuuccacuacgaggagugcucgugcuaccccgacaccgggaccgucaugugcgugugccgcgacaacuggcacggcuccaaccggcccugggugagcuucaaccagaaccuggacuaccagaucggcuacaucugcacgggggucuucggcgacaacccccgcccggaggacggggagggcuccugcaaccccgugaccguggacggggcgaacggcgucaagggcuucucguacaaguacgggaacggcguguggaucgggcggaccaaguccaaccgcauccggaagggcuucgagaugaucugggaccccaacggguggaccaacacggacagcgacuucuccgugaagcaggacaucgucgccaucaccgacuggucgggcuacuccggcagcuucgugcagcaccccgagcugaccgggcucgacugcauccgcccgugcuucuggguggagcugguccggggccugccccgcgagaacaccacgaucuggaccucgggguccagcaucuccuucugcggcgugaacagcgacaucgccaacugguccuggcccgacggcgccgagcuccccuucaccaucgacaaguga

SEQ ID NO: 24761 - RNA, 1413 nt, Artificial Sequence
  derived and/or modified CDS sequence (AUadapt) from InfluenzaA__AFJ78598__NA
augaaccccaaccagaagaucaucaccaucggcucgaucuccaucgccaucgggaucaucagccugaugcuccagaucggcaacaucaucuccaucugggccucgcacuccauccagaccgggauccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacagcucccugugcucgaucuccggcugggccaucuacaccaaggacaacagcauccggaucggguccaagggcgacguguucgugauccgcgagccguucaucucgugcucccaccucgagugccggacguucuuccugacccagggggcccugcucaacgacaagcacagcaacggcaccgucaaggaccgcucccccuaccgggcccugaugagcugcccccugggggaggcgcccuccccguacaacucgaaguucgagagcguggccugguccgccagcgccugccacgacggcaugggcuggcucaccaucgggaucuccggccccgacaacggggcgguggccguccugaaguacaacggcaucaucacgggcaccaucaagucguggaagaagcagauccugcgcacccaggaguccgagugcgugugcaugaacgggagcugcuucaccaucaugacggacggccccuccaacaaggccgccucguacaagaucuucaagaucgagaaggggaaggugaccaaguccaucgagcucaacgcccccaacuuccacuacgaggagugcagcugcuacccggacaccggcaucgucaugugcgugugccgggacaacuggcacggguccaaccgccccugggugagcuucaaccagaaccuggacuaccagaucggcuacaucugcuccggcgucuucggggacaacccccggcccgaggacggcgaggggucgugcaacccggugaccguggacggcgcgaacggggucaagggcuucuccuacaaguacgacaacggcguguggaucgggcgcaccaagagcaaccggcugcgcaagggcuucgagaugaucugggaccccaacggguggacgaacaccgacuccgacuucucggugaagcaggacgucguggccaucaccgacugguccggcuacagcgggagcuucgugcagcaccccgagcucacgggccuggacugcauccggcccugcuucugggucgagcuggugcgcggccucccgcgggagaacaccaccaucuggaccuccgggucguccaucagcuucugcggcgucaacuccgacacggccaacuggagcuggcccgacggggccgagcugcccuucaccaucgacaaguga

SEQ ID NO: 24762 - RNA, 1413 nt, Artificial Sequence
  derived and/or modified CDS sequence (AUadapt) from InfluenzaA__AFJ78609__NA
augaaccccaaccagaagaucaucaccaucggcucgaucuccaucgccaucgggaucaucagccugaugcuccagaucggcaacaucaucuccaucugggccagccacuccauccagaccgggucgcagaacaacacgggcaucugcaaccagcgcaucaucaccuacgagaacuccaccugggugaaccacaccuacgucaacaucaacaacacgaacgugguggcgggggaggacaagaccagcgucauccuggccggcaacuccagccugugcuccaucucgggcugggccaucuacaccaaggacaacuccauccggaucgggagcaagggcgacguguucgugauccgcgagccguucaucuccugcagccaccucgagugccggaccuucuuccugacgcagggggcccugcucaacgacaagcacuccaacggcaccgucaaggaccgcucgcccuaccgggcccugauguccugcccccugggggaggcgcccagcccguacaacagcaaguucgaguccguggccuggagcgccuccgccugccacgacggcaugggcuggcucaccaucgggaucucgggccccgacaacggggcgguggccguccugaaguacaacggcaucaucaccggcacgaucaaguccuggaagaagcagauccugcgcacccaggagagcgagugcgugugcaugaacggguccugcuucaccaucaugaccgacggccccagcaacaaggccgccuccuacaagaucuucaagaucgagaaggggaaggugaccaagucgaucgagcucaacgcccccaacuucuacuacgaggagugcuccugcuacccggacacgggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucucguacaaguacggcaacgggguguggaucggccgcaccaaguccaaccggcugcgcaagggguucgagaugaucugggaccccaacggcuggacgaacaccgacagcgacuucuccgugaagcaggacgucguggccaucaccgacuggagcggguacucgggcuccuucgugcagcaccccgagcucaccggccuggacugcauccggcccugcuucugggucgagcuggugcgcgggcucccgcgggagaacacgaccaucuggaccagcggcuccagcaucuccuucugcggggucaacagcgacaccgccaacugguccuggcccgacggcgccgagcugcccuucacgaucgacaaguga

SEQ ID NO: 24763 - RNA, 1413 nt, Artificial Sequence; identical to SEQ ID NO: 19863
  derived and/or modified CDS sequence (AUadapt) from InfluenzaA__AFJ78620__NA

SEQ ID NO: 24764 - RNA, 1413 nt, Artificial Sequence; identical to SEQ ID NO: 24637
  derived and/or modified CDS sequence (AUadapt) from InfluenzaA__AFJ78631__NA

SEQ ID NO: 24765 - RNA, 1413 nt, Artificial Sequence; identical to SEQ ID NO: 19863
  derived and/or modified CDS sequence (AUadapt) from InfluenzaA__AFJ78642__NA

SEQ ID NO: 24766 - RNA, 1413 nt, Artificial Sequence; identical to SEQ ID NO: 19863
  derived and/or modified CDS sequence (AUadapt) from InfluenzaA__AFJ78653__NA

SEQ ID NO: 24767 - RNA, 1410 nt, Artificial Sequence; identical to SEQ ID NO: 16318
  derived and/or modified CDS sequence (AUadapt) from InfluenzaA__AFJ78664__NA

SEQ ID NO: 24768 - RNA, 1410 nt, Artificial Sequence; identical to SEQ ID NO: 16318
  derived and/or modified CDS sequence (AUadapt) from InfluenzaA__AFJ78674__NA

SEQ ID NO: 24769 - RNA, 1410 nt, Artificial Sequence; identical to SEQ ID NO: 16318
  derived and/or modified CDS sequence (AUadapt) from InfluenzaA__AFJ78684__NA

SEQ ID NO: 24770 - RNA, 1410 nt, Artificial Sequence; identical to SEQ ID NO: 16318
  derived and/or modified CDS sequence (AUadapt) from InfluenzaA__AFJ78694__NA

SEQ ID NO: 24771 - RNA, 1410 nt, Artificial Sequence; identical to SEQ ID NO: 16318
  derived and/or modified CDS sequence (AUadapt) from InfluenzaA__AFJ78704__NA

SEQ ID NO: 24772 - RNA, 1410 nt, Artificial Sequence; identical to SEQ ID NO: 16318
  derived and/or modified CDS sequence (AUadapt) from InfluenzaA__AFJ78714__NA

SEQ ID NO: 24773 - RNA, 1410 nt, Artificial Sequence
  derived and/or modified CDS sequence (AUadapt) from InfluenzaA__AFJ78724__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucacccucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccuggaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccucgacugcauccgccccugcuucuggguggagcugauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 24774 - RNA, 1410 nt, Artificial Sequence; identical to SEQ ID NO: 16318
  derived and/or modified CDS sequence (AUadapt) from InfluenzaA__AFJ78734__NA

SEQ ID NO: 24775 - RNA, 1410 nt, Artificial Sequence; identical to SEQ ID NO: 16318
  derived and/or modified CDS sequence (AUadapt) from InfluenzaA__AFJ78744__NA

SEQ ID NO: 24776 - RNA, 1410 nt, Artificial Sequence; identical to SEQ ID NO: 16318
  derived and/or modified CDS sequence (AUadapt) from InfluenzaA__AFJ78754__NA

SEQ ID NO: 24777 - RNA, 1410 nt, Artificial Sequence; identical to SEQ ID NO: 16318
  derived and/or modified CDS sequence (AUadapt) from InfluenzaA__AFJ78764__NA

SEQ ID NO: 24778 - RNA, 1410 nt, Artificial Sequence; identical to SEQ ID NO: 16318
  derived and/or modified CDS sequence (AUadapt) from InfluenzaA__AFJ78774__NA

SEQ ID NO: 24779 - RNA, 1410 nt, Artificial Sequence; identical to SEQ ID NO: 16318
  derived and/or modified CDS sequence (AUadapt) from InfluenzaA__AFJ78784__NA

SEQ ID NO: 24780 - RNA, 1410 nt, Artificial Sequence
  derived and/or modified CDS sequence (AUadapt) from InfluenzaA__AFJ78794__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccggcgagaucacgugcgugugccgggacaacuggcacgggagcaaccgccccugggucuccuucaaccagaaccucgaguaccagaucggcuacaucugcagcgggaucuucggcgacaacccgcggcccaacgacaagaccggcuccugcgggcccgugagcuccaacggcgccaacggggugaagggcuucucguucaaguacgggaacggcgucuggaucggccgcaccaaguccaucagcagccggaacggguucgagaugaucugggaccccaacggcuggaccgggaccgacaacaacuucuccaucaagcaggacaucgugggcaucaacgaguggagcggguacuccggcucguucgugcagcacccggagcugacgggccuggacugcauccgccccugcuucugggucgagcucauccgggggcgccccaaggagaacaccaucuggaccuccggcagcuccaucagcuucugcggggugaacuccgacaccgucggcuggagcuggcccgacggcgccgagcugccguucacgaucgacaaguga

SEQ ID NO: 24781 - RNA, 1410 nt, Artificial Sequence; identical to SEQ ID NO: 16318
  derived and/or modified CDS sequence (AUadapt) from InfluenzaA__AFJ78804__NA

SEQ ID NO: 24782 - RNA, 1410 nt, Artificial Sequence; identical to SEQ ID NO: 16318
  derived and/or modified CDS sequence (AUadapt) from InfluenzaA__AFJ78814__NA

SEQ ID NO: 24783 - RNA, 1410 nt, Artificial Sequence; identical to SEQ ID NO: 16318
  derived and/or modified CDS sequence (AUadapt) from InfluenzaA__AFJ78824__NA

SEQ ID NO: 24784 - RNA, 1410 nt, Artificial Sequence; identical to SEQ ID NO: 16318
  derived and/or modified CDS sequence (AUadapt) from InfluenzaA__AFJ78834__NA

SEQ ID NO: 24785 - RNA, 1410 nt, Artificial Sequence; identical to SEQ ID NO: 16318
  derived and/or modified CDS sequence (AUadapt) from InfluenzaA__AFJ78844__NA

SEQ ID NO: 24786 - RNA, 1410 nt, Artificial Sequence; identical to SEQ ID NO: 21389
  derived and/or modified CDS sequence (AUadapt) from InfluenzaA__AFJ78854__NA

SEQ ID NO: 24787 - RNA, 1410 nt, Artificial Sequence; identical to SEQ ID NO: 16318
  derived and/or modified CDS sequence (AUadapt) from InfluenzaA__AFJ78864__NA

SEQ ID NO: 24788 - RNA, 1410 nt, Artificial Sequence; identical to SEQ ID NO: 16318
  derived and/or modified CDS sequence (AUadapt) from InfluenzaA__AFJ78874__NA

SEQ ID NO: 24789 - RNA, 1410 nt, Artificial Sequence; identical to SEQ ID NO: 16318
  derived and/or modified CDS sequence (AUadapt) from InfluenzaA__AFJ78884__NA

SEQ ID NO: 24790 - RNA, 1410 nt, Artificial Sequence; identical to SEQ ID NO: 16318
  derived and/or modified CDS sequence (AUadapt) from InfluenzaA__AFJ78894__NA

SEQ ID NO: 24791 - RNA, 1410 nt, Artificial Sequence; identical to SEQ ID NO: 16318
  derived and/or modified CDS sequence (AUadapt) from InfluenzaA__AFJ78904__NA

SEQ ID NO: 24792 - RNA, 1410 nt, Artificial Sequence; identical to SEQ ID NO: 16318
  derived and/or modified CDS sequence (AUadapt) from InfluenzaA__AFJ78914__NA

SEQ ID NO: 24793 - RNA, 1410 nt, Artificial Sequence
  derived and/or modified CDS sequence (AUadapt) from InfluenzaA__AFJ78924__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacguggacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagauccccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggucgugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 24794 - RNA, 1410 nt, Artificial Sequence
  derived and/or modified CDS sequence (AUadapt) from InfluenzaA__AFJ97569__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgagaccaucaaggaccggucccccuaccgcacgcugaugucgugcccgaucggggagguccccucccccuacaacagccgguucgagagcguggccugguccgcgagcgccugccacgacggcaucaacuggcucaccaucgggaucuccggccccgacaacggcgccguggccguccugaaguacaacgggaucaucaccgacaccaucaagagcuggcgcaacaacauccugcggacgcaggaguccgagugcgcgugcgugaacggcucgugcuucaccgugaugaccgacgggccguccgacggccaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucagcuucaaccagaaccucgaguaccagaucggcuacaucugcuccgggaucuucggcgacaacccgcggcccaacgacaagaccgggucgugcggccccguguccagcaacggcgccaacggggugaagggcuucuccuucaaguacgggaacggcgucuggaucgggcgcaccaagagcaucagcucccggaacggcuucgagaugaucugggaccccaacggcuggaccgggaccgacaacaacuucagcaucaagcaggacaucgugggcaucaacgagugguccggguacucgggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucuccuggagcuggcccgacggcgccgagcugccguucacgaucgacaaguga

SEQ ID NO: 24795 - RNA, 1410 nt, Artificial Sequence; identical to SEQ ID NO: 16274
  derived and/or modified CDS sequence (AUadapt) from InfluenzaA__AFK14107__NA

SEQ ID NO: 24796 - RNA, 1410 nt, Artificial Sequence; identical to SEQ ID NO: 16318
  derived and/or modified CDS sequence (AUadapt) from InfluenzaA__AFK14117__NA

SEQ ID NO: 24797 - RNA, 1410 nt, Artificial Sequence; identical to SEQ ID NO: 19907
  derived and/or modified CDS sequence (AUadapt) from InfluenzaA__AFK14141__NA

SEQ ID NO: 24798 - RNA, 1410 nt, Artificial Sequence
  derived and/or modified CDS sequence (AUadapt) from InfluenzaA__AFK14150__NA
augaaccccaaccagaagaucaucaccaucggcucggugugcaugaccaucgggauggccaaccugauccuccagaucggcaacaucaucuccaucuggaucagccacuccauccgccuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccggaucggcuccaagggggacguguucgugauccgcgagcccuucaucagcugcagcccccuggagugccggaccuucuuccugacccagggcgcccuccugaacgacaagcacuccaacgggaccaucaaggaccgcucccccuaccggacgcugaugucgugcccgaucggcgagguccccucccccuacaacagccgcuucgagagcguggccugguccgcgagcgccugccacgacgggaucaacuggcucaccaucggcaucuccggccccgacaacggggccguggccguccugaaguacaacggcaucaucaccgacaccaucaagagcuggcggaacaacauccugcgcacgcaggaguccgagugcgcgugcgugaacgggucgugcuucaccgugaugaccgacggcccguccgacgagcaggccagcuacaagaucuuccggaucgagaagggcaagaucgucaaguccguggagaugaacgcccccaacuaccacuacgaggagugcagcugcuaccccgacuccagcgagaucacgugcgugugccgcgacaacuggcacggguccaaccggcccugggucucguucaaccagaaccucgaguaccagaucggcuacaucugcuccgggaucuucggcgacaacccgcgccccaacgacaagaccgggagcugcggccccguguccagcaacggcgccaacggggugaagggcuucuccuucaaguacgggaacggcgucuggaucgggcggaccaagagcaucagcucccgcaacggcuucgagaugaucugggaccccaacggcuggaccgggaccgacaacaacuucucgaucaagcaggacaucgugggcaucaacgagugguccggguacagcggcuccuucgugcagcacccggagcugacggggcuggacugcauccggcccugcuucugggucgagcucauccgcggccggcccaaggagaacaccaucuggaccagcggcuccagcaucuccuucugcggggugaacagcgacaccgucggcugguccuggcccgacggggccgagcugccguucacgaucgacaaguga

SEQ ID NO: 24799 - RNA, 1410 nt, Artificial Sequence; identical to SEQ ID NO: 19723
  derived and/or modified CDS sequence (AUadapt) from InfluenzaA__AFK14159__NA

SEQ ID NO: 24800 - RNA, 1410 nt, Artificial Sequence; identical to SEQ ID NO: 16318
  derived and/or modified CDS sequence (AUadapt) from InfluenzaA__AFK14168__NA

SEQ ID NO: 24801 - RNA, 1410 nt, Artificial Sequence; identical to SEQ ID NO: 16318
  derived and/or modified CDS sequence (AUadapt) from InfluenzaA__AFK14177__NA

SEQ ID NO: 24802 - RNA, 1410 nt, Artificial Sequence
  derived and/or modified CDS sequence (AUadapt) from InfluenzaA__AFK14186__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuucgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 24803 - RNA, 1410 nt, Artificial Sequence; identical to SEQ ID NO: 21121
  derived and/or modified CDS sequence (AUadapt) from InfluenzaA__AFK14195__NA

SEQ ID NO: 24804 - RNA, 1410 nt, Artificial Sequence; identical to SEQ ID NO: 16318
  derived and/or modified CDS sequence (AUadapt) from InfluenzaA__AFK14204__NA

SEQ ID NO: 24805 - RNA, 1410 nt, Artificial Sequence; identical to SEQ ID NO: 21121
  derived and/or modified CDS sequence (AUadapt) from InfluenzaA__AFK14213__NA

SEQ ID NO: 24806 - RNA, 1410 nt, Artificial Sequence
  derived and/or modified CDS sequence (AUadapt) from InfluenzaA__AFK14222__NA
augaaccccaaccagaagaucaucaccaucggcucggugugcaugaccaucgggauggccaaccugauccuccagaucggcaacaucaucuccaucuggaucagccacuccauccgccuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccggaucggcuccaagggggacguguucgugauccgcgagcccuucaucagcugcagcccccuggagugccggaccuucuuccugacccagggcgcccuccugaacgacaagcacuccaacgggaccaucaaggaccgcucccccuaccggacgcugaugucgugcccgaucggcgagguccccucccccuacaacagccgcuucgagagcguggccugguccgcgagcgccugccacgacgggaucaacuggcucaccaucggcaucuccggccccgacaacggggccguggccguccugaaguacaacggcaucaucaccgacaccaucaagagcuggcggaacaacauccugcgcacgcaggaguccgagugcgcgugcgugaacgggucgugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucucguucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 24807 - RNA, 1410 nt, Artificial Sequence; identical to SEQ ID NO: 19723
  derived and/or modified CDS sequence (AUadapt) from InfluenzaA__AFK14231__NA

SEQ ID NO: 24808 - RNA, 1410 nt, Artificial Sequence; identical to SEQ ID NO: 16318
  derived and/or modified CDS sequence (AUadapt) from InfluenzaA__AFK14240__NA

SEQ ID NO: 24809 - RNA, 1410 nt, Artificial Sequence; identical to SEQ ID NO: 19907
  derived and/or modified CDS sequence (AUadapt) from InfluenzaA__AFK14249__NA

SEQ ID NO: 24810 - RNA, 1410 nt, Artificial Sequence; identical to SEQ ID NO: 16318
  derived and/or modified CDS sequence (AUadapt) from InfluenzaA__AFK14257__NA

SEQ ID NO: 24811 - RNA, 1410 nt, Artificial Sequence; identical to SEQ ID NO: 16318
  derived and/or modified CDS sequence (AUadapt) from InfluenzaA__AFK14266__NA

SEQ ID NO: 24812 - RNA, 1410 nt, Artificial Sequence; identical to SEQ ID NO: 16318
  derived and/or modified CDS sequence (AUadapt) from InfluenzaA__AFK14274__NA

SEQ ID NO: 24813 - RNA, 1410 nt, Artificial Sequence
  derived and/or modified CDS sequence (AUadapt) from InfluenzaA__AFK14281__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccgacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 24814 - RNA, 1410 nt, Artificial Sequence; identical to SEQ ID NO: 16318
  derived and/or modified CDS sequence (AUadapt) from InfluenzaA__AFK14289__NA

SEQ ID NO: 24815 - RNA, 1410 nt, Artificial Sequence; identical to SEQ ID NO: 19723
  derived and/or modified CDS sequence (AUadapt) from InfluenzaA__AFK14298__NA

SEQ ID NO: 24816 - RNA, 1410 nt, Artificial Sequence; identical to SEQ ID NO: 16318
  derived and/or modified CDS sequence (AUadapt) from InfluenzaA__AFK14307__NA

SEQ ID NO: 24817 - RNA, 1410 nt, Artificial Sequence; identical to SEQ ID NO: 21121
  derived and/or modified CDS sequence (AUadapt) from InfluenzaA__AFK14316__NA

SEQ ID NO: 24818 - RNA, 1410 nt, Artificial Sequence
  derived and/or modified CDS sequence (AUadapt) from InfluenzaA__AFK14325__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagcgggggaagaucgucaaguccguggagaugaacgcccccaacuaccacuacgaggagugcagcugcuaccccgacuccagcgagaucacgugcgugugccgcgacaacuggcacggcuccaaccggcccugggucucguucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 24819 - RNA, 1410 nt, Artificial Sequence; identical to SEQ ID NO: 16318
  derived and/or modified CDS sequence (AUadapt) from InfluenzaA__AFK14334__NA

SEQ ID NO: 24820 - RNA, 1410 nt, Artificial Sequence; identical to SEQ ID NO: 16318
  derived and/or modified CDS sequence (AUadapt) from InfluenzaA__AFK14343__NA

SEQ ID NO: 24821 - RNA, 1410 nt, Artificial Sequence; identical to SEQ ID NO: 16318
  derived and/or modified CDS sequence (AUadapt) from InfluenzaA__AFK14352__NA

SEQ ID NO: 24822 - RNA, 1410 nt, Artificial Sequence; identical to SEQ ID NO: 16318
  derived and/or modified CDS sequence (AUadapt) from InfluenzaA__AFK14360__NA

SEQ ID NO: 24823 - RNA, 1410 nt, Artificial Sequence; identical to SEQ ID NO: 16318
  derived and/or modified CDS sequence (AUadapt) from InfluenzaA__AFK14369__NA

SEQ ID NO: 24824 - RNA, 1410 nt, Artificial Sequence
  derived and/or modified CDS sequence (AUadapt) from InfluenzaA__AFK14387__NA
augaaccccaaccagaagaucaucaccaucggcucggugugcaugaccaucgggauggccaaccugauccuccagaucggcaacaucacguccaucuggaucagccacuccauccagcuggggaaccagaaccagaucgacacgugcaaccagagcgucaucaccuacgagaacaacaccugggugaaccagaccuacgugaacaucuccaacaccaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacucgggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 24825 - RNA, 1410 nt, Artificial Sequence; identical to SEQ ID NO: 19723
  derived and/or modified CDS sequence (AUadapt) from InfluenzaA__AFK14397__NA

SEQ ID NO: 24826 - RNA, 1410 nt, Artificial Sequence; identical to SEQ ID NO: 16318
  derived and/or modified CDS sequence (AUadapt) from InfluenzaA__AFK14406__NA

SEQ ID NO: 24827 - RNA, 1410 nt, Artificial Sequence; identical to SEQ ID NO: 16318
  derived and/or modified CDS sequence (AUadapt) from InfluenzaA__AFK14415__NA

SEQ ID NO: 24828 - RNA, 1410 nt, Artificial Sequence; identical to SEQ ID NO: 16318
  derived and/or modified CDS sequence (AUadapt) from InfluenzaA__AFK14424__NA

SEQ ID NO: 24829 - RNA, 1410 nt, Artificial Sequence
  derived and/or modified CDS sequence (AUadapt) from InfluenzaA__AFK14433__NA
augaaccccaaccagaagaucaucaccaucggcucggugugcaugaucaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagucgguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 24830 - RNA, 1410 nt, Artificial Sequence; identical to SEQ ID NO: 16318
  derived and/or modified CDS sequence (AUadapt) from InfluenzaA__AFK14442__NA

SEQ ID NO: 24831 - RNA, 1410 nt, Artificial Sequence
  derived and/or modified CDS sequence (AUadapt) from InfluenzaA__AFK14451__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagucggucgccuccgccaagcuggccgggaacagcucccucugcccggugagcggcugggccaucuacuccaaggacaacagcauccgcaucggcuccaagggggacguguucgucauccgggagcccuucaucucgugcagcccccuggagugccgcaccuucuuccugacccagggcgcgcuccugaacgacaagcacuccaacgggaccaucaaggaccggucccccuaccgcacgcugaugagcugcccgaucggcgaggugcccucccccuacaacucgcgguucgagagcguggccugguccgccagcgccugccacgacgggaucaacuggcucaccaucggcaucuccggccccgacaacggggcggucgccgugcugaaguacaacggcaucaucaccgacaccaucaagagcuggcgcaacaacauccugcggacgcaggaguccgagugcgccugcgugaacgggucgugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccucggagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggcgaacggcgucaagggguucuccuucaaguacggcaacgggguguggaucggccgcaccaagucgaucagcucccggaacggcuucgagaugaucugggaccccaacggguggaccggcaccgacaacaacuucagcaucaagcaggacaucguggggaucaacgagugguccggcuacucgggguccuucguccagcacccggagcugacgggccuggacugcauccgccccugcuucuggguggagcucauccggggccgccccaaggagaacaccaucuggaccagcggguccaucaucagcuucugcggcgugaacuccgacaccgucggguggagcuggcccgacggcgccgagcugccguucacgaucgacaaguga

SEQ ID NO: 24832 - RNA, 1410 nt, Artificial Sequence; identical to SEQ ID NO: 16318
  derived and/or modified CDS sequence (AUadapt) from InfluenzaA__AFK14458__NA

SEQ ID NO: 24833 - RNA, 1410 nt, Artificial Sequence; identical to SEQ ID NO: 16318
  derived and/or modified CDS sequence (AUadapt) from InfluenzaA__AFK14467__NA

SEQ ID NO: 24834 - RNA, 1410 nt, Artificial Sequence; identical to SEQ ID NO: 16318
  derived and/or modified CDS sequence (AUadapt) from InfluenzaA__AFK14476__NA

SEQ ID NO: 24835 - RNA, 1410 nt, Artificial Sequence; identical to SEQ ID NO: 22199
  derived and/or modified CDS sequence (AUadapt) from InfluenzaA__AFK14485__NA

SEQ ID NO: 24836 - RNA, 1410 nt, Artificial Sequence; identical to SEQ ID NO: 16318
  derived and/or modified CDS sequence (AUadapt) from InfluenzaA__AFK14504__NA

SEQ ID NO: 24837 - RNA, 1410 nt, Artificial Sequence; identical to SEQ ID NO: 16318
  derived and/or modified CDS sequence (AUadapt) from InfluenzaA__AFK14514__NA

SEQ ID NO: 24838 - RNA, 1410 nt, Artificial Sequence; identical to SEQ ID NO: 16318
  derived and/or modified CDS sequence (AUadapt) from InfluenzaA__AFK14522__NA

SEQ ID NO: 24839 - RNA, 1410 nt, Artificial Sequence; identical to SEQ ID NO: 16318
  derived and/or modified CDS sequence (AUadapt) from InfluenzaA__AFK14529__NA

SEQ ID NO: 24840 - RNA, 1410 nt, Artificial Sequence; identical to SEQ ID NO: 16318
  derived and/or modified CDS sequence (AUadapt) from InfluenzaA__AFK14538__NA

SEQ ID NO: 24841 - RNA, 1410 nt, Artificial Sequence; identical to SEQ ID NO: 21515
  derived and/or modified CDS sequence (AUadapt) from InfluenzaA__AFK14547__NA

SEQ ID NO: 24842 - RNA, 1410 nt, Artificial Sequence
  derived and/or modified CDS sequence (AUadapt) from InfluenzaA__AFK14555__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucaucuccgugaagcuggccgggaacucgucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggucgugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 24843 - RNA, 1410 nt, Artificial Sequence; identical to SEQ ID NO: 16318
  derived and/or modified CDS sequence (AUadapt) from InfluenzaA__AFK14564__NA

SEQ ID NO: 24844 - RNA, 1410 nt, Artificial Sequence; identical to SEQ ID NO: 16318
  derived and/or modified CDS sequence (AUadapt) from InfluenzaA__AFK14573__NA

SEQ ID NO: 24845 - RNA, 1410 nt, Artificial Sequence
  derived and/or modified CDS sequence (AUadapt) from InfluenzaA__AFK14579__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaugugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 24846 - RNA, 1410 nt, Artificial Sequence; identical to SEQ ID NO: 16318
  derived and/or modified CDS sequence (AUadapt) from InfluenzaA__AFK14588__NA

SEQ ID NO: 24847 - RNA, 1410 nt, Artificial Sequence; identical to SEQ ID NO: 16318
  derived and/or modified CDS sequence (AUadapt) from InfluenzaA__AFK14597__NA

SEQ ID NO: 24848 - RNA, 1410 nt, Artificial Sequence; identical to SEQ ID NO: 16318
  derived and/or modified CDS sequence (AUadapt) from InfluenzaA__AFK14604__NA

SEQ ID NO: 24849 - RNA, 1410 nt, Artificial Sequence; identical to SEQ ID NO: 16318
  derived and/or modified CDS sequence (AUadapt) from InfluenzaA__AFK14632__NA

SEQ ID NO: 24850 - RNA, 1410 nt, Artificial Sequence; identical to SEQ ID NO: 16274
  derived and/or modified CDS sequence (AUadapt) from InfluenzaA__AFK14641__NA

SEQ ID NO: 24851 - RNA, 1410 nt, Artificial Sequence; identical to SEQ ID NO: 16318
  derived and/or modified CDS sequence (AUadapt) from InfluenzaA__AFK14651__NA

SEQ ID NO: 24852 - RNA, 1410 nt, Artificial Sequence; identical to SEQ ID NO: 16318
  derived and/or modified CDS sequence (AUadapt) from InfluenzaA__AFK14656__NA

SEQ ID NO: 24853 - RNA, 1410 nt, Artificial Sequence; identical to SEQ ID NO: 16318
  derived and/or modified CDS sequence (AUadapt) from InfluenzaA__AFK14663__NA

SEQ ID NO: 24854 - RNA, 1410 nt, Artificial Sequence; identical to SEQ ID NO: 16318
  derived and/or modified CDS sequence (AUadapt) from InfluenzaA__AFK14672__NA

SEQ ID NO: 24855 - RNA, 1410 nt, Artificial Sequence; identical to SEQ ID NO: 16318
  derived and/or modified CDS sequence (AUadapt) from InfluenzaA__AFK14680__NA

SEQ ID NO: 24856 - RNA, 1410 nt, Artificial Sequence; identical to SEQ ID NO: 16318
  derived and/or modified CDS sequence (AUadapt) from InfluenzaA__AFK14690__NA

SEQ ID NO: 24857 - RNA, 1410 nt, Artificial Sequence; identical to SEQ ID NO: 16318
  derived and/or modified CDS sequence (AUadapt) from InfluenzaA__AFK14707__NA

SEQ ID NO: 24858 - RNA, 1410 nt, Artificial Sequence; identical to SEQ ID NO: 16318
  derived and/or modified CDS sequence (AUadapt) from InfluenzaA__AFK14715__NA

SEQ ID NO: 24859 - RNA, 1410 nt, Artificial Sequence; identical to SEQ ID NO: 16318
  derived and/or modified CDS sequence (AUadapt) from InfluenzaA__AFK14724__NA

SEQ ID NO: 24860 - RNA, 1410 nt, Artificial Sequence; identical to SEQ ID NO: 16318
  derived and/or modified CDS sequence (AUadapt) from InfluenzaA__AFK14733__NA

SEQ ID NO: 24861 - RNA, 1410 nt, Artificial Sequence; identical to SEQ ID NO: 16318
  derived and/or modified CDS sequence (AUadapt) from InfluenzaA__AFK14751__NA

SEQ ID NO: 24862 - RNA, 1410 nt, Artificial Sequence; identical to SEQ ID NO: 16318
  derived and/or modified CDS sequence (AUadapt) from InfluenzaA__AFK14757__NA

SEQ ID NO: 24863 - RNA, 1410 nt, Artificial Sequence; identical to SEQ ID NO: 16318
  derived and/or modified CDS sequence (AUadapt) from InfluenzaA__AFK14766__NA

SEQ ID NO: 24864 - RNA, 1410 nt, Artificial Sequence; identical to SEQ ID NO: 19723
  derived and/or modified CDS sequence (AUadapt) from InfluenzaA__AFK14774__NA

SEQ ID NO: 24865 - RNA, 1410 nt, Artificial Sequence; identical to SEQ ID NO: 24842
  derived and/or modified CDS sequence (AUadapt) from InfluenzaA__AFK14781__NA

SEQ ID NO: 24866 - RNA, 1410 nt, Artificial Sequence; identical to SEQ ID NO: 19723
  derived and/or modified CDS sequence (AUadapt) from InfluenzaA__AFK14790__NA

SEQ ID NO: 24867 - RNA, 1410 nt, Artificial Sequence
  derived and/or modified CDS sequence (AUadapt) from InfluenzaA__AFK14800__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgcccccgggagaacaccaucuggaccagcggguccagcaucuccuucugcggcgugaacagcgacaccgucgggugguccuggcccgacggcgccgagcugccguucacgaucgacaaguga

SEQ ID NO: 24868 - RNA, 1410 nt, Artificial Sequence; identical to SEQ ID NO: 21121
  derived and/or modified CDS sequence (AUadapt) from InfluenzaA__AFK14809__NA

SEQ ID NO: 24869 - RNA, 1410 nt, Artificial Sequence; identical to SEQ ID NO: 21121
  derived and/or modified CDS sequence (AUadapt) from InfluenzaA__AFK14816__NA

SEQ ID NO: 24870 - RNA, 1410 nt, Artificial Sequence; identical to SEQ ID NO: 16318
  derived and/or modified CDS sequence (AUadapt) from InfluenzaA__AFK14824__NA

SEQ ID NO: 24871 - RNA, 1410 nt, Artificial Sequence; identical to SEQ ID NO: 16318
  derived and/or modified CDS sequence (AUadapt) from InfluenzaA__AFK14841__NA

SEQ ID NO: 24872 - RNA, 1410 nt, Artificial Sequence; identical to SEQ ID NO: 20213
  derived and/or modified CDS sequence (AUadapt) from InfluenzaA__AFK14849__NA

SEQ ID NO: 24873 - RNA, 1410 nt, Artificial Sequence
  derived and/or modified CDS sequence (AUadapt) from InfluenzaA__AFK14856__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagucgguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuucaagaucgagaaggggaagaucgugaaguccguggagaugaacgcccccaacuaccacuacgaggagugcucgugcuaccccgacuccagcgagaucacgugcgucugccgcgacaacuggcacggcuccaaccggcccugggugagcuucaaccagaaccucgaguaccagaucggguacaucugcuccggcaucuucggggacaacccgcgccccaucgacaagaccggcagcugcggccccguguccagcaacggggccaacggcgucaagggguucuccuucaaguacggcaacgggguguggaucggccggaccaagagcaucucgucccgcaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 24874 - RNA, 1410 nt, Artificial Sequence; identical to SEQ ID NO: 16318
  derived and/or modified CDS sequence (AUadapt) from InfluenzaA__AFK14870__NA

SEQ ID NO: 24875 - RNA, 1410 nt, Artificial Sequence; identical to SEQ ID NO: 16318
  derived and/or modified CDS sequence (AUadapt) from InfluenzaA__AFK14879__NA

SEQ ID NO: 24876 - RNA, 1410 nt, Artificial Sequence; identical to SEQ ID NO: 16318
  derived and/or modified CDS sequence (AUadapt) from InfluenzaA__AFK14885__NA

SEQ ID NO: 24877 - RNA, 1410 nt, Artificial Sequence; identical to SEQ ID NO: 16318
  derived and/or modified CDS sequence (AUadapt) from InfluenzaA__AFK14894__NA

SEQ ID NO: 24878 - RNA, 1410 nt, Artificial Sequence; identical to SEQ ID NO: 16318
  derived and/or modified CDS sequence (AUadapt) from InfluenzaA__AFK14903__NA

SEQ ID NO: 24879 - RNA, 1410 nt, Artificial Sequence; identical to SEQ ID NO: 16318
  derived and/or modified CDS sequence (AUadapt) from InfluenzaA__AFK14912__NA

SEQ ID NO: 24880 - RNA, 1410 nt, Artificial Sequence; identical to SEQ ID NO: 16318
  derived and/or modified CDS sequence (AUadapt) from InfluenzaA__AFK14921__NA

SEQ ID NO: 24881 - RNA, 1410 nt, Artificial Sequence; identical to SEQ ID NO: 16318
  derived and/or modified CDS sequence (AUadapt) from InfluenzaA__AFK14931__NA

SEQ ID NO: 24882 - RNA, 1410 nt, Artificial Sequence
  derived and/or modified CDS sequence (AUadapt) from InfluenzaA__AFK25604__NA
augaaccccaaccagaagaucaucaccaucggcucggugugcaugaccaucgggauggccaaccugauccuccagaucggcaacaucaucuccaucuggaucagccacuccauccagcugcgcaaccagagccagaucgagacgugcaaccaguccgucaucaccuacgagaacaacaccugggugaaccagaccuacgugaacaucagcaacacgaacuucgccgcggggcaguccgucgugagcgugaagcuggccggcaacuccucgcucugcccggucuccgggugggccaucuacagcaaggacaacuccauccggaucggcagcaagggcgacguguucgugauccgcgagcccuucaucuccugcagcccccuggagugccggaccuucuuccugacccagggggcccuccugaacgacaagcacuccaacggcaccaucaaggaccgcagccccuaccggacgcugauguccugcccgaucggggagguccccagccccuacaacucgcgcuucgaguccguggccuggagcgcguccgccugccacgacggcaucaacuggcucaccaucgggaucagcggccccgacaacggcgccguggccguccugaaguacaacgggaucaucaccgacaccaucaaguccuggcggaacaacauccugcgcacgcaggagagcgagugcgcgugcgugaacggcuccugcuucaccaucaugaccgacgggccgagcgacggccaggccuccuacaagaucuuccggaucgagaagggcaagaucgucaagagcguggagaugaacgcccccaacuacuacuacgaggagugcuccugcuaccccgacucguccgagaucacgugcgugugccgcgacaacuggcacgggagcaaccggcccuggguguccuucaaccagaaccucgaguaccagaucggcuacaucugcagcgggaucuucggcgacaacccgcgccccaacgacaagaccggguccugcggccccgucagcuccaacggcgccaacggggugaagggcuucagcuucaaguacgggaacggcguguggaucgggcggaccaagagcaucuccucgcgcaagggcuucgagaugaucugggaccccaacggcuggaccgggaccgacaacaacuucuccaucaagcaggacaucgucggcaucaacgaguggagcggguacuccggcagcuucgugcagcacccggagcugacggggcuggacugcauccggcccugcuucuggguggagcucauccgcggccggcccaaggagaacaccaucuggaccuccggcagcuccaucagcuucugcggggucaacuccgacaccgugggcuggagcuggcccgacggggccgagcugccguucacgaucgacaaguga

SEQ ID NO: 24883 - RNA, 1410 nt, Artificial Sequence; identical to SEQ ID NO: 24882
  derived and/or modified CDS sequence (AUadapt) from InfluenzaA__AFK25606__NA

SEQ ID NO: 24884 - RNA, 1410 nt, Artificial Sequence; identical to SEQ ID NO: 20491
  derived and/or modified CDS sequence (AUadapt) from InfluenzaA__AFK74537__NA

SEQ ID NO: 24885 - RNA, 1410 nt, Artificial Sequence; identical to SEQ ID NO: 16318
  derived and/or modified CDS sequence (AUadapt) from InfluenzaA__AFK74547__NA

SEQ ID NO: 24886 - RNA, 1410 nt, Artificial Sequence; identical to SEQ ID NO: 22132
  derived and/or modified CDS sequence (AUadapt) from InfluenzaA__AFK74557__NA

SEQ ID NO: 24887 - RNA, 1410 nt, Artificial Sequence; identical to SEQ ID NO: 16318
  derived and/or modified CDS sequence (AUadapt) from InfluenzaA__AFK74567__NA

SEQ ID NO: 24888 - RNA, 1410 nt, Artificial Sequence; identical to SEQ ID NO: 16318
  derived and/or modified CDS sequence (AUadapt) from InfluenzaA__AFK74578__NA

SEQ ID NO: 24889 - RNA, 1410 nt, Artificial Sequence; identical to SEQ ID NO: 24255
  derived and/or modified CDS sequence (AUadapt) from InfluenzaA__AFK74588__NA

SEQ ID NO: 24890 - RNA, 1410 nt, Artificial Sequence; identical to SEQ ID NO: 16318
  derived and/or modified CDS sequence (AUadapt) from InfluenzaA__AFK74598__NA

SEQ ID NO: 24891 - RNA, 1410 nt, Artificial Sequence; identical to SEQ ID NO: 16318
  derived and/or modified CDS sequence (AUadapt) from InfluenzaA__AFK74608__NA

SEQ ID NO: 24892 - RNA, 1410 nt, Artificial Sequence; identical to SEQ ID NO: 16318
  derived and/or modified CDS sequence (AUadapt) from InfluenzaA__AFK74618__NA

SEQ ID NO: 24893 - RNA, 1410 nt, Artificial Sequence; identical to SEQ ID NO: 16318
  derived and/or modified CDS sequence (AUadapt) from InfluenzaA__AFK74628__NA

SEQ ID NO: 24894 - RNA, 1410 nt, Artificial Sequence; identical to SEQ ID NO: 16318
  derived and/or modified CDS sequence (AUadapt) from InfluenzaA__AFK74638__NA

SEQ ID NO: 24895 - RNA, 1410 nt, Artificial Sequence; identical to SEQ ID NO: 16318
  derived and/or modified CDS sequence (AUadapt) from InfluenzaA__AFK74648__NA

SEQ ID NO: 24896 - RNA, 1410 nt, Artificial Sequence; identical to SEQ ID NO: 24264
  derived and/or modified CDS sequence (AUadapt) from InfluenzaA__AFK74658__NA

SEQ ID NO: 24897 - RNA, 1410 nt, Artificial Sequence; identical to SEQ ID NO: 24264
  derived and/or modified CDS sequence (AUadapt) from InfluenzaA__AFK74668__NA

SEQ ID NO: 24898 - RNA, 1410 nt, Artificial Sequence; identical to SEQ ID NO: 16318
  derived and/or modified CDS sequence (AUadapt) from InfluenzaA__AFK74678__NA

SEQ ID NO: 24899 - RNA, 1410 nt, Artificial Sequence; identical to SEQ ID NO: 16318
  derived and/or modified CDS sequence (AUadapt) from InfluenzaA__AFK74688__NA

SEQ ID NO: 24900 - RNA, 1410 nt, Artificial Sequence; identical to SEQ ID NO: 16318
  derived and/or modified CDS sequence (AUadapt) from InfluenzaA__AFK74698__NA

SEQ ID NO: 24901 - RNA, 1410 nt, Artificial Sequence; identical to SEQ ID NO: 24271
  derived and/or modified CDS sequence (AUadapt) from InfluenzaA__AFK74708__NA

SEQ ID NO: 24902 - RNA, 1410 nt, Artificial Sequence; identical to SEQ ID NO: 22132
  derived and/or modified CDS sequence (AUadapt) from InfluenzaA__AFK74718__NA

SEQ ID NO: 24903 - RNA, 1410 nt, Artificial Sequence; identical to SEQ ID NO: 16318
  derived and/or modified CDS sequence (AUadapt) from InfluenzaA__AFK74728__NA

SEQ ID NO: 24904 - RNA, 1410 nt, Artificial Sequence; identical to SEQ ID NO: 16318
  derived and/or modified CDS sequence (AUadapt) from InfluenzaA__AFK74738__NA

SEQ ID NO: 24905 - RNA, 1410 nt, Artificial Sequence; identical to SEQ ID NO: 16318
  derived and/or modified CDS sequence (AUadapt) from InfluenzaA__AFK74748__NA

SEQ ID NO: 24906 - RNA, 1410 nt, Artificial Sequence; identical to SEQ ID NO: 16318
  derived and/or modified CDS sequence (AUadapt) from InfluenzaA__AFK74758__NA

SEQ ID NO: 24907 - RNA, 1410 nt, Artificial Sequence; identical to SEQ ID NO: 16318
  derived and/or modified CDS sequence (AUadapt) from InfluenzaA__AFK74768__NA

SEQ ID NO: 24908 - RNA, 1410 nt, Artificial Sequence; identical to SEQ ID NO: 16318
  derived and/or modified CDS sequence (AUadapt) from InfluenzaA__AFK74778__NA

SEQ ID NO: 24909 - RNA, 1410 nt, Artificial Sequence; identical to SEQ ID NO: 22132
  derived and/or modified CDS sequence (AUadapt) from InfluenzaA__AFK74788__NA

SEQ ID NO: 24910 - RNA, 1410 nt, Artificial Sequence; identical to SEQ ID NO: 22132
  derived and/or modified CDS sequence (AUadapt) from InfluenzaA__AFK74798__NA

SEQ ID NO: 24911 - RNA, 1410 nt, Artificial Sequence; identical to SEQ ID NO: 22132
  derived and/or modified CDS sequence (AUadapt) from InfluenzaA__AFK74808__NA

SEQ ID NO: 24912 - RNA, 1410 nt, Artificial Sequence; identical to SEQ ID NO: 22132
  derived and/or modified CDS sequence (AUadapt) from InfluenzaA__AFK74818__NA

SEQ ID NO: 24913 - RNA, 1410 nt, Artificial Sequence; identical to SEQ ID NO: 16318
  derived and/or modified CDS sequence (AUadapt) from InfluenzaA__AFK74828__NA

SEQ ID NO: 24914 - RNA, 1410 nt, Artificial Sequence; identical to SEQ ID NO: 21031
  derived and/or modified CDS sequence (AUadapt) from InfluenzaA__AFK74838__NA

SEQ ID NO: 24915 - RNA, 1410 nt, Artificial Sequence; identical to SEQ ID NO: 16318
  derived and/or modified CDS sequence (AUadapt) from InfluenzaA__AFK74848__NA

SEQ ID NO: 24916 - RNA, 1410 nt, Artificial Sequence; identical to SEQ ID NO: 16318
  derived and/or modified CDS sequence (AUadapt) from InfluenzaA__AFK74898__NA

SEQ ID NO: 24917 - RNA, 1410 nt, Artificial Sequence; identical to SEQ ID NO: 16318
  derived and/or modified CDS sequence (AUadapt) from InfluenzaA__AFK74908__NA

SEQ ID NO: 24918 - RNA, 1410 nt, Artificial Sequence; identical to SEQ ID NO: 16318
  derived and/or modified CDS sequence (AUadapt) from InfluenzaA__AFK74918__NA

SEQ ID NO: 24919 - RNA, 1410 nt, Artificial Sequence; identical to SEQ ID NO: 16318
  derived and/or modified CDS sequence (AUadapt) from InfluenzaA__AFK74928__NA

SEQ ID NO: 24920 - RNA, 1410 nt, Artificial Sequence
  derived and/or modified CDS sequence (AUadapt) from InfluenzaA__AFK74938__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaacaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 24921 - RNA, 1410 nt, Artificial Sequence; identical to SEQ ID NO: 16318
  derived and/or modified CDS sequence (AUadapt) from InfluenzaA__AFK74948__NA

SEQ ID NO: 24922 - RNA, 1410 nt, Artificial Sequence; identical to SEQ ID NO: 21031
  derived and/or modified CDS sequence (AUadapt) from InfluenzaA__AFK74958__NA

SEQ ID NO: 24923 - RNA, 1410 nt, Artificial Sequence; identical to SEQ ID NO: 22132
  derived and/or modified CDS sequence (AUadapt) from InfluenzaA__AFK74968__NA

SEQ ID NO: 24924 - RNA, 1410 nt, Artificial Sequence; identical to SEQ ID NO: 16318
  derived and/or modified CDS sequence (AUadapt) from InfluenzaA__AFK74978__NA

SEQ ID NO: 24925 - RNA, 1410 nt, Artificial Sequence; identical to SEQ ID NO: 21031
  derived and/or modified CDS sequence (AUadapt) from InfluenzaA__AFK74988__NA

SEQ ID NO: 24926 - RNA, 1410 nt, Artificial Sequence; identical to SEQ ID NO: 16318
  derived and/or modified CDS sequence (AUadapt) from InfluenzaA__AFK74998__NA

SEQ ID NO: 24927 - RNA, 1410 nt, Artificial Sequence; identical to SEQ ID NO: 22132
  derived and/or modified CDS sequence (AUadapt) from InfluenzaA__AFK75008__NA

SEQ ID NO: 24928 - RNA, 1410 nt, Artificial Sequence; identical to SEQ ID NO: 16318
  derived and/or modified CDS sequence (AUadapt) from InfluenzaA__AFK75018__NA

SEQ ID NO: 24929 - RNA, 1410 nt, Artificial Sequence; identical to SEQ ID NO: 16318
  derived and/or modified CDS sequence (AUadapt) from InfluenzaA__AFK75028__NA

SEQ ID NO: 24930 - RNA, 1410 nt, Artificial Sequence; identical to SEQ ID NO: 16318
  derived and/or modified CDS sequence (AUadapt) from InfluenzaA__AFK75038__NA

SEQ ID NO: 24931 - RNA, 1410 nt, Artificial Sequence; identical to SEQ ID NO: 16318
  derived and/or modified CDS sequence (AUadapt) from InfluenzaA__AFK75048__NA

SEQ ID NO: 24932 - RNA, 1410 nt, Artificial Sequence; identical to SEQ ID NO: 16318
  derived and/or modified CDS sequence (AUadapt) from InfluenzaA__AFK75058__NA

SEQ ID NO: 24933 - RNA, 1410 nt, Artificial Sequence; identical to SEQ ID NO: 22132
  derived and/or modified CDS sequence (AUadapt) from InfluenzaA__AFK75068__NA

SEQ ID NO: 24934 - RNA, 1410 nt, Artificial Sequence; identical to SEQ ID NO: 16318
  derived and/or modified CDS sequence (AUadapt) from InfluenzaA__AFK75078__NA

SEQ ID NO: 24935 - RNA, 1410 nt, Artificial Sequence; identical to SEQ ID NO: 16318
  derived and/or modified CDS sequence (AUadapt) from InfluenzaA__AFK75088__NA

SEQ ID NO: 24936 - RNA, 1410 nt, Artificial Sequence; identical to SEQ ID NO: 16318
  derived and/or modified CDS sequence (AUadapt) from InfluenzaA__AFK75098__NA

SEQ ID NO: 24937 - RNA, 1410 nt, Artificial Sequence; identical to SEQ ID NO: 21053
  derived and/or modified CDS sequence (AUadapt) from InfluenzaA__AFK75108__NA

SEQ ID NO: 24938 - RNA, 1410 nt, Artificial Sequence; identical to SEQ ID NO: 16318
  derived and/or modified CDS sequence (AUadapt) from InfluenzaA__AFK77860__NA

SEQ ID NO: 24939 - RNA, 1410 nt, Artificial Sequence; identical to SEQ ID NO: 16318
  derived and/or modified CDS sequence (AUadapt) from InfluenzaA__AFK77870__NA

SEQ ID NO: 24940 - RNA, 1410 nt, Artificial Sequence; identical to SEQ ID NO: 16318
  derived and/or modified CDS sequence (AUadapt) from InfluenzaA__AFK77880__NA

SEQ ID NO: 24941 - RNA, 1410 nt, Artificial Sequence
  derived and/or modified CDS sequence (AUadapt) from InfluenzaA__AFK77890__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagggcaucagcagccggaacggguucgagaugaucugggaccccaacggcuggaccgggaccgacaacaacuucuccaucaagcaggacaucgugggcaucaacgaguggagcggguacuccggcucguucgugcagcacccggagcugacgggccuggacugcauccgccccugcuucugggucgagcucauccgggggcgccccaaggagaacaccaucuggaccuccggcagcuccaucagcuucugcggggugaacuccgacaccgucggcuggagcuggcccgacggcgccgagcugccguucacgaucgacaaguga

SEQ ID NO: 24942 - RNA, 1410 nt, Artificial Sequence
  derived and/or modified CDS sequence (AUadapt) from InfluenzaA__AFK77900__NA
augaaccccaaccagaagaucaucaccaucggcucggugugcaugaccaucgggauggccaaccugauccuccagaucggcaacaucaucuccaucuggaucagccacuccauccagaucgggaaccagaaccagaucgagacgugcaaccagagcgucaucaccuacgagaacaacaccugggugaaccagaccuacgugaacaucuccaacacgaacuucgccgcgggccagagcgucgccuccgugaagcuggccgggaacucgucccugugcccggugagcggcugggccaucuacuccaaggacaacagcauccgcaucggcuccaagggggacgucuucgugauccgggagcccuucaucagcugcucgccccucgagugccgcaccuucuuccugacccagggcgcccugcucaacgacaagcacuccaacgggaccaucaaggaccggucccccuaccgcgcgcugaugagcugcccgaucggcgaggugcccucccccuacaacagccgguucgagagcgucgccugguccgccucggccugccacgacgggaucaacuggcugacgaucggcaucuccggccccgacaacggggcgguggccgugcucaaguacaacggcaucaucaccgacaccaucaagagcuggcgcaacaacauccugcggacccaggaguccgagugcgccugcgucaacgggagcugcuucacgaucaugaccgacggcccguccgacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccuggaguaccagaucggguacaucugcuccggcaucuucggggacaacccgcggcccaacgacaagaccggcagcugcggccccguguccucgaacggggcgaacggcgucaagggguucuccuucaaguacggcaacgggguguggaucggccgcaccaagagcaucagcucccggaagggcuucgagaugaucugggaccccaacggguggaccggcaccgacaacaacuucagcaucaagcaggacaucguggggaugaacgagugguccggcuacucgggguccuucguccagcacccggagcucaccggccuggacugcauccgccccugcuucuggguggagcugauccggggccgccccaaggagaacacgaucuggaccagcggguccagcaucuccuucugcggcgugaacagcgacaccgucgggugguccuggcccgacggcgccgagcucccguucaccaucgacaaguga

SEQ ID NO: 24943 - RNA, 1410 nt, Artificial Sequence
  derived and/or modified CDS sequence (AUadapt) from InfluenzaA__AFK78031__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucgccuccgugaagcuggccgggaacucgucccucugcccggugagcggcugggccaucuacuccaaggacaacagcauccgcaucggcuccaagggggacgucuucgugauccgggagcccuucaucagcugcucgccccuggagugccgcaccuucuuccugacccagggcgcccuccugaacgacaagcacuccaacgggaccaucaaggaccggucccccuaccgcgcgcugaugagcugcccgaucggcgaggugcccucccccuacaacagccgguucgagagcgucgccugguccgccucggccugccacgacgggaucaacuggcucacgaucggcaucuccggccccgacaacggggcgguggccgugcugaaguacaacggcaucaucaccgacaccaucaagagcuggcgcaacaacauccugcggacccaggaguccgagugcgccugcgucaacgggagcugcuucacgaucaugaccgacggcccguccgacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccucgaacggggcgaacggcgucaagggguucuccuucaaguacggcaacgggguguggaucggccgcaccaagagcaucagcucccggaagggcuucgagaugaucugggaccccaacggguggaccggcaccgacaacaacuucagcaucaagcaggacaucguggggaugaacgagugguccggcuacucgggguccuucguccagcacccggagcugaccggccuggacugcauccgccccugcuucuggguggagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 24944 - RNA, 1410 nt, Artificial Sequence; identical to SEQ ID NO: 16318
  derived and/or modified CDS sequence (AUadapt) from InfluenzaA__AFK78190__NA

SEQ ID NO: 24945 - RNA, 1362 nt, Artificial Sequence
  derived and/or modified CDS sequence (AUadapt) from InfluenzaA__AFM68957__NA
augaaucccaaccagaagaucaucaccaucggcucgaucugcaugguggucgggaucaucucccugauccuccagaucggcaacaucaucagcaucuggaucucccacagcauccagaccgggaaucagaaccacacgggcaucugcaaccaggggaucaucacccacaacgugguggccggccaggacuccaccagugucauccugaccggcaacuccagccugugcccgauccgcgggugggccauccacuccaaggacaacggcauccggaucgggagcaagggcgacguguuugugauccgcgagcccuucaucuccugcagccaccucgagugccggacguucuuccugacccagggggcgcugcucaaugacaagcacuccuacggcaccagcaaggaccgcucccccuaccgggcccugaugagcugucccgucggcgaggccccgucccccuacaacagccgcuucgaguccguggccuggagcgccagcgcgugccacgaugggaugggcuggcugaccaucgggaucuccggccccgacaacggcgccguggccguccucaaguacaacgggaucaucacggagaccaucaagagcuggcggaagaagauccugcgcacccaggaguccgagugcacgugcgugaauggcucgugcuucaccaucaugaccgacgggcccuccgacggccuggccagcuacaagaucuucaagaucgagaaggggaaggugaccaaguccaucgagcucaaugcgccgaacagccacuacgaggagugcuccugcuaccccgauaccggcaaggucaugugcgugugccgggacaacuggcacggcagcaaccgccccuggguguccuuugaccagaaccuggacuaccagaucggguacaucugcagcggcgucuucggggauaacccccggccgaaggacggcacgggguccugcggccccgugagcgccgacggcgccaacggggugaagggcuucuccuaucgcuacgggaacggcgucuggaucgggcggaccaagagcgacuccagccgccacggcuucgagaugaucugggaucccaacggcuggaccgagaccgacucccgguucagcgugcgccaggacguggucgccaugacggaccggagcggguacuccggcaguuucgugcagcaccccgagcugaccgggcucgacugcaugcgcccgugcuucuggguggagcugauccggggccagcccgaggaggagaccaucuggaccuccggcagcaucaucuccuuuugcggggucaacagcgacacgguggacugguccuggcccgacggcgccgagcugcccuucaccaucgacaaguga

SEQ ID NO: 24946 - RNA, 1410 nt, Artificial Sequence
  derived and/or modified CDS sequence (AUadapt) from InfluenzaA__AFM68968__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccucguccucgugccacgacggcaaggcguggcuccacgucugcgugacgggguacgacaagaacgccaccgccuccuucaucuacgacggccggcugguggacagcaucggguccuggucgaagaacauccugcgcacccaggaguccgagugcgucugcaucaacgggaccugcacgguggugaugaccgacggcagcgccuccgagcgggcggacaccaagauccucuucaucgaggaggggaagaucguccacaucucgccccugucgggcuccgcccagcacguggaggagugcagcugcuacccccgcuacccgggggugcggugcgucugccgcgacaacuggaagggcuccaaccggcccaucguggacaucaacgugaaggacuacucgaucgccuccagcuacgucugcuccggccuggugggggacacgccccgcaagaacgaccggucguccucguccuacugccgcaaccccaacaacgagaagggcaaccacggggugaagggcugggccuucgacgacgggaacgacgucuggaugggccggaccaucagcgaggagucccgcucgggcuacgagaccuucaaggugaucgggggcugguccaccccgaacagcaagcuccagaucaaccggcaggucaucguggacuccgacaaccgcucgggguacuccggcaucuucucgguggagggcaagagcugcaucaaccggugcuucuacgucgagcugauccgcggccgcgagcaggagacccgggugugguggacguccaacucgaucguggucuucugcggcaccuccgggaccuacggcaccgggagcuggcccgacggcgccgacaucaaccugaugcccaucuga

SEQ ID NO: 24947 - RNA, 1410 nt, Artificial Sequence
  derived and/or modified CDS sequence (AUadapt) from InfluenzaA__AFM68979__NA
augaaccccaaccagaagaucaucaccaucggcucggugucccugaccaucgccacgaucugcuuccucaugcagaucgccauccuggucaccaccgugacccugcacuucaagcaguacgagugcagcuccccgcccaacaaccaggugaugcccugcgagcccaucaucaucgagcgcaacaucacggagaucgucuaccucaccaacaccaccaucgagaaggagaucugcccgaagcugguggaguaccggaacuggucgaagccccagugcaagaucacgggguucgcgcccuucuccaaggacaacagcauccgccuguccgccggcgggggcaucugggugacccgggagcccuacgucucgugcgacccggggaagugcuaccaguucgcccucggccagggcaccacccuggacaacaagcacuccaacgacacgauccacgaccgcacccccuaccggacccugcucaugaacgagcugggggugcccuuccaccugggcacccgccaggugugcaucgccuggagcuccucguccugccacgacgggaaggccuggcuccacgucugcgugacgggcuacgacaagaacgcgaccgccagcuucaucuacgacgggcggcugguggacuccaucggcucgugguccaagaacauccugcgcacccaggagagcgagugcgucugcaucaacgggaccugcacgguggugaugaccgacggcuccgccucggagcgggccgacaccaagauccucuucaucgaggagggcaagaucguccacaucagcccccuguccgggucggcgcagcacguggaggagugcuccugcuacccgcgcuaccccggcgugcggugcgucugccgcgacaacuggaagggcagcaaccggcccgugguggacaucaacgucaaggacuacuccaucgugucguccuacgugugcagcgggcuggucggcgacacgccccgcaagaacgaccgguccucguccagcuacugccgcaacccgaacaacgagaaggggaaccacggcgugaaggggugggccuucgacgacggcaacgacgucuggaugggccggaccaucuccgaggagucgcgcuccggguacgagaccuucaaggugaucggcggguggagcacccccaacuccaagcuccagaucaaccgccaggugaucgucgacucggacaaccgguccggcuacagcgggaucuucucgguggagggcaaguccugcaucaaccggugcuucuacguggagcugauccgcggccgcgagcaggagacccgggucugguggacgagcaacuccaucgugguguucugcgggaccagcggcaccuacgggaccggcuccuggcccgacggggccgacaucaaccugaugcccaucuga

SEQ ID NO: 24948 - RNA, 1410 nt, Artificial Sequence; identical to SEQ ID NO: 24947
  derived and/or modified CDS sequence (AUadapt) from InfluenzaA__AFM68990__NA

SEQ ID NO: 24949 - RNA, 1410 nt, Artificial Sequence; identical to SEQ ID NO: 17215
  derived and/or modified CDS sequence (AUadapt) from InfluenzaA__AFM71723__NA

SEQ ID NO: 24950 - RNA, 1410 nt, Artificial Sequence; identical to SEQ ID NO: 24537
  derived and/or modified CDS sequence (AUadapt) from InfluenzaA__AFM71734__NA

SEQ ID NO: 24951 - RNA, 1410 nt, Artificial Sequence; identical to SEQ ID NO: 24351
  derived and/or modified CDS sequence (AUadapt) from InfluenzaA__AFM71745__NA

SEQ ID NO: 24952 - RNA, 1410 nt, Artificial Sequence; identical to SEQ ID NO: 21011
  derived and/or modified CDS sequence (AUadapt) from InfluenzaA__AFM71771__NA

SEQ ID NO: 24953 - RNA, 1410 nt, Artificial Sequence; identical to SEQ ID NO: 24037
  derived and/or modified CDS sequence (AUadapt) from InfluenzaA__AFM71782__NA

SEQ ID NO: 24954 - RNA, 1410 nt, Artificial Sequence; identical to SEQ ID NO: 24037
  derived and/or modified CDS sequence (AUadapt) from InfluenzaA__AFM71794__NA

SEQ ID NO: 24955 - RNA, 1410 nt, Artificial Sequence; identical to SEQ ID NO: 19001
  derived and/or modified CDS sequence (AUadapt) from InfluenzaA__AFM71805__NA

SEQ ID NO: 24956 - RNA, 1410 nt, Artificial Sequence
  derived and/or modified CDS sequence (AUadapt) from InfluenzaA__AFM71827__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaaggacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 24957 - RNA, 1410 nt, Artificial Sequence; identical to SEQ ID NO: 21920
  derived and/or modified CDS sequence (AUadapt) from InfluenzaA__AFM71838__NA

SEQ ID NO: 24958 - RNA, 1365 nt, Artificial Sequence; identical to SEQ ID NO: 16322
  derived and/or modified CDS sequence (AUadapt) from InfluenzaA__AFM71849__NA

SEQ ID NO: 24959 - RNA, 1410 nt, Artificial Sequence; identical to SEQ ID NO: 16337
  derived and/or modified CDS sequence (AUadapt) from InfluenzaA__AFM71860__NA

SEQ ID NO: 24960 - RNA, 1410 nt, Artificial Sequence; identical to SEQ ID NO: 16729
  derived and/or modified CDS sequence (AUadapt) from InfluenzaA__AFM71871__NA

SEQ ID NO: 24961 - RNA, 1410 nt, Artificial Sequence; identical to SEQ ID NO: 16729
  derived and/or modified CDS sequence (AUadapt) from InfluenzaA__AFM71882__NA

SEQ ID NO: 24962 - RNA, 1410 nt, Artificial Sequence
  derived and/or modified CDS sequence (AUadapt) from InfluenzaA__AFM71893__NA
augaaccccaaccagaagaucaucaccaucggcucggugucccugaccaucgccacggucugcuuccucaugcagaucgccauccuggcgaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccgaggugguggaguaccggaacuggucgaagccgcagugccagaucaccggguucgcccccuucuccaaggacaacagcauccgccuguccgccggcggggacaucugggucacgcgggagcccuacgugucgugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggcguggucguccagcuccugccacgacgggaaggccuggcugcacgugugcgucaccggcgacgaccgcaacgccaccgccucguucaucuacgacgggcggcucguggacuccaucggcucguggucccagaacauccugcgcacgcaggagagcgagugcgugugcaucaacgggaccugcaccgucgugaugaccgacggcuccgcgucgggccgggccgacacgcgcauccuguucaucaaggaggggaagaucgugcacaucucgccccucuccggcagcgcccagcacaucgaggagugcuccugcuacccccgguacccggacguccgcugcaucugccgggacaacuggaagggcucgaaccgccccgugaucgacaucaacauggaggacuacuccaucgacucguccuacgugugcagcgggcuggucggcgacacgccccggaacgacgacuccucguccaacucgaacugccgcgaccccaacaacgagcgggggaacccgggcgugaaggggugggccuucgacaacggcgacgacguguggaugggccgcaccaucaacaaggagucccggagcggguacgagaccuucaaggucaucggcgggugguccacccccaacucgaagucccaggugaaccgccaggucaucguggacaacaacaacuggucgggcuacuccgggaucuucagcguggagggcaagucgugcaucaaccggugcuucuacgucgagcugauccgcggccgcccccaggagacccgggugugguggaccuccaacucgaucguggucuucugcgggaccuccggcacguacgggaccggcagcuggcccgacggggccaacaucaacuucaugccgaucuga

SEQ ID NO: 24963 - RNA, 1410 nt, Artificial Sequence
  derived and/or modified CDS sequence (AUadapt) from InfluenzaA__AFM71904__NA
augaaccccaaccagaagaucaucaccaucggcucggugucccugaccaucgccacggucugcuuccucaugcagaucgccauccuggcgaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacucgauccgccuguccgccggcggggacaucugggucacgcgggagcccuacgugucgugcgaccccggcaagugcuaccaguucgcccuggggcagggcaccacccucgacaacaagcacuccaacgugaccauccacgaccgcaucccgcaccggacgcugcugaugaacgagcucggcguccccuuccaccuggggaccaagcaggucugcguggcguggagcuccucguccugccacgacggcaaggccuggcugcacgugugcgugaccggggacgaccgcaacgccaccgccucguucaucuacgacggccggcucguggacuccaucgggagcuggucccagaacauccugcgcacgcaggagucggagugcgucugcaucaacgggaccugcaccguggugaugaccgacggcuccgcgucgggccgggccgacacgcgcauccuguucaucaaggagggcaagaucguccacaucagcccccucuccgggucggcccagcacaucgaggagugcuccugcuacccccgguacccggacgugcgcugcaucugccgggacaacuggaagggcucgaaccgccccgugaucgacaucaacauggaggacuacuccaucgacagcggcuacgucugcuccgggcuggugggcgacacgccccggaacgacgacucguccucgaacuccaacugccgcgaccccaacaacgagcgggggaacccgggcgugaaggggugggccuucgacaacggcgacgacgucuggaugggccgcaccaucaacaaggagagccgguccggguacgagaccuucaaggugaucggcggguggucgacccccaacuccaagucgcaggucaaccgccaggugaucguggacaacaacaacugguccggcuacagcgggaucuucuccgucgagggcaagucgugcaucaaccggugcuucuacguggagcugauccgcggccgcccccaggagacccgggugugguggaccucgaacuccaucgucguguucugcgggaccagcggcacguacgggaccggcuccuggcccgacggggccaacaucaacuucaugccgaucuga

SEQ ID NO: 24964 - RNA, 1410 nt, Artificial Sequence; identical to SEQ ID NO: 17374
  derived and/or modified CDS sequence (AUadapt) from InfluenzaA__AFM71915__NA

SEQ ID NO: 24965 - RNA, 1410 nt, Artificial Sequence; identical to SEQ ID NO: 17374
  derived and/or modified CDS sequence (AUadapt) from InfluenzaA__AFM71926__NA

SEQ ID NO: 24966 - RNA, 1410 nt, Artificial Sequence; identical to SEQ ID NO: 17374
  derived and/or modified CDS sequence (AUadapt) from InfluenzaA__AFM71937__NA

SEQ ID NO: 24967 - RNA, 1410 nt, Artificial Sequence; identical to SEQ ID NO: 24382
  derived and/or modified CDS sequence (AUadapt) from InfluenzaA__AFM71948__NA

SEQ ID NO: 24968 - RNA, 1410 nt, Artificial Sequence; identical to SEQ ID NO: 24382
  derived and/or modified CDS sequence (AUadapt) from InfluenzaA__AFM71959__NA

SEQ ID NO: 24969 - RNA, 1410 nt, Artificial Sequence
  derived and/or modified CDS sequence (AUadapt) from InfluenzaA__AFM71970__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccuacgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccuggagaacaagcacagcaacgacacgauccacgaccgcaccccgcaccggacccugcucaugaacgagcugggcgugcccuuccaccuggggacccgccaggugugcaucgccugguccucguccucgugccacgacggcaaggcguggcuccacgucugcgugacgggguacgacaagaacgccaccgccuccuucaucuacgacggccggcugguggacagcaucggguccuggucgcagaacauccugcgcacccaggaguccgagugcgucugcaucaacgggaccugcacgguggugaugaccgacggcagcgccuccggccgggcggacaccaagauccucuucaucgaggagggcaagaucguccacaucucgccccugucgggguccgcccagcacguggaggagugcagcugcuacccccgcuacccgggcgugcggugcaucugccgcgacaacuggaagggcuccaaccggcccgucguggacaucaacgugaaggacuacucgaucgacuccagcuacgucugcuccgggcuggugggcgacacgccccgcaagaacgaccggucguccucguccuacugccgcaaccccaacaacgagaaggggaaccacggcgugaaggggugggccuucgacgacggcaacgacgucuggaugggccggaccaucagcgaggacucccgcucgggguacgagaccuucaaggugaucggcgggugguccaccccgaacagcaagcuccagaucaaccggcaggucaucguggacuccgccaaccgcucgggcuacuccgggaucuucucgguggagggcaagagcugcaucaaccggugcuucuacgucgagcugauccgcggccgcgagcaggagacccgggugugguggacguccaacucgaucguggucuucugcgggaccuccggcaccuacgggaccggcagcuggcccgacggggccgacaucaaccugaugcccaucuga

SEQ ID NO: 24970 - RNA, 1410 nt, Artificial Sequence; identical to SEQ ID NO: 24390
  derived and/or modified CDS sequence (AUadapt) from InfluenzaA__AFM71981__NA

SEQ ID NO: 24971 - RNA, 1410 nt, Artificial Sequence
  derived and/or modified CDS sequence (AUadapt) from InfluenzaA__AFM71992__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucguggucccaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaugaaccgccaggugaucguggaccggggcaaccgcuccggguacucgggcaucuucuccgucgagggcaagagcugcaucaaccggugcuucuacguggagcucauccgcgggcggaaggaggagaccgaggugcuguggaccucgaacuccaucgucguguucugcggcacgagcgggaccuacggcaccggguccuggccggacggcgccgaccugaaccucaugcccaucuga

SEQ ID NO: 24972 - RNA, 1410 nt, Artificial Sequence; identical to SEQ ID NO: 24946
  derived and/or modified CDS sequence (AUadapt) from InfluenzaA__AFM72013__NA

SEQ ID NO: 24973 - RNA, 1365 nt, Artificial Sequence; identical to SEQ ID NO: 16322
  derived and/or modified CDS sequence (AUadapt) from InfluenzaA__AFM72024__NA

SEQ ID NO: 24974 - RNA, 1410 nt, Artificial Sequence; identical to SEQ ID NO: 21397
  derived and/or modified CDS sequence (AUadapt) from InfluenzaA__AFM72035__NA

SEQ ID NO: 24975 - RNA, 1410 nt, Artificial Sequence; identical to SEQ ID NO: 21397
  derived and/or modified CDS sequence (AUadapt) from InfluenzaA__AFM72046__NA

SEQ ID NO: 24976 - RNA, 1413 nt, Artificial Sequence
  derived and/or modified CDS sequence (AUadapt) from InfluenzaA__AFM72057__NA
augaaccccaaccagaagaucaucaccaucggcucgaucugcaccacgaucgggaucaucucccugauccuccagaucggcaacaucaucagcaucugggugucccacucgauccagaccgggucccagaaccacaccggcaucugcaaccagcgcaucaucaccuacgagaacagcacgugggucaaccagaccuacgugaacaucaacaacaccaacguggucgccgggaaggacaccacguccgugacccuggccggcaacucgucccugugcccgauccggggcugggcgaucuacagcaaggacaacuccauccgcaucgggucgaagggcgacguguucgucauccgggagcccuucaucuccugcagccaccucgagugccgcaccuucuuccugacccagggggcccugcucaacgacaagcacuccaacggcacggugaaggaccggucgcccuaccgcgcccugauguccugccccaucggggaggccccgagccccuacaacucccgguucgagucgguggccuggagcgcguccgccugccacgacggcaugggcuggcugaccaucgggaucucgggccccgacgacggggccgucgccgugcucaaguacaacggcaucaucaccgagaccaucaaguccuggcgcaagcggauccugcgcacgcaggagagcgagugcgugugcgucaacggcuccugcuucaccaucaugaccgacgggcccucgaacggcccggcguccuaccggaucuucaagaucgagaaggggaagaucaccaagagcaucgagcuggacgcccccaacucccacuacgaggagugcucgugcuaccccgacacgggcaccgugaugugcgugugccgcgacaacuggcacggguccaaccggcccugggucagcuucaaccagaaccucgacuaccagaucggcuacaucugcuccggcguguucggggacaacccgcgccccaaggacggcaaggggucgugcgaccccgugaccgucgacggcgccgacggggugaagggcuucuccuaccgguacggcaacgggguguggaucggccgcaccaagagcaacuccucgcggaagggguucgagaugaucugggaccccaacggcuggacggacaccgacuccaacuuccuggucaagcaggacgugguggccaugaccgacuggagcggguacucgggcuccuucguccagcacccggagcugaccggccucgacugcaugcgccccugcuucuggguggagcugauccgggggcgcccccgggagaagacgaccaucuggaccagcggcuccucgaucuccuucugcggggucaacagcgacaccgccaacugguccuggcccgacggcgcggagcugccguucacgaucgacaaguga

SEQ ID NO: 24977 - RNA, 1413 nt, Artificial Sequence; identical to SEQ ID NO: 17461
  derived and/or modified CDS sequence (AUadapt) from InfluenzaA__AFM72068__NA

SEQ ID NO: 24978 - RNA, 1410 nt, Artificial Sequence
  derived and/or modified CDS sequence (AUadapt) from InfluenzaA__AFM72090__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacucgauccgccuguccgccggcggggacaucugggugacccgggagcccuacgucagcugcgacccgggcaagugcuaccaguucgcccucgggcagggcaccacccugaacaacaagcacuccaacgacacggugcacgaccgcacccccuaccggacccugcucaugaacgagcugggcgugcccuuccaccuggggaccaagcaggucugcaucgccuggucguccagcuccugccacgacggcaaggccuggcuccacgugugcgugacggggcacgacaagaacgcgaccgccucguucaucuacgacggccgccuggucgacuccaucgggagcugguccaagaacauccugcggacccaggagucggagugcgugugcaucaacgggaccugcacgguggucaugaccgacggcuccgccagcgagcgcgccgacaccaagauccucuucaucgaggagggcaagaucgugcacaucucgccccuguccggcucggcgcagcacguggaggagugcuccugcuacccgcgguaccccgggguccgcugcgugugccgggacaacuggaagggcagcaaccgccccaucguggacaucaacgucaaggacuacuccaucgugucguccuacgugugcagcggccuggucggggacacgccccggaagaacgaccgcuccucguccagcuacugccggaacccgaacaacgagaagggcaaccacggggugaagggcugggccuucgacgacgggaacgacgucuggaugggccgcaccaucggcgaggagcuccggcugggguacgagaccuucaaggugaucggcgggugguccacccccaacucgaagcugcagaucaaccgccaggugaucgucgacuccaagaaccggagcggcuacuccgggaucuucucgguggagggcaaguccugcaucaaccgcugcuucuacguggagcucauccggggccgcgagcaggagacccgcgucugguggacgagcaacucgaucgugguguucugcgggaccuccggcaccuacgggaccggcagcuggcccgacggggccgacaucaaccugaugcccaucuga

SEQ ID NO: 24979 - RNA, 1410 nt, Artificial Sequence
  derived and/or modified CDS sequence (AUadapt) from InfluenzaA__AFM72101__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggcgaugcccugcgagcccacgaucaucgagcgcaacaucaccgagaucguguaccucaccaacaccacgaucgagaaggagaucugcccgaagcuggucgaguaccggaacuggagcaagccccagugcaagaucaccggguucgcccccuucuccaaggacaacucgauccgccuguccgccggcggggacaucugggugacccgggagcccuacgugagcugcgacccgggcaagugcuaccaguucgcccucgggcagggcaccacgcugaacaaccgccacuccaacgacaccguccacgaccggacccccuaccgcacccugcucaugaacgagcugggcgugcccuuccaccuggggacgaagcaggucugcaucgccuggucguccucguccugccacgacggcaaggcguggcuccacgugugcgugaccgggcacgacaagaacgccaccgccagcuucaucuacgacggccggcugguggacuccaucgggucgugguccaagaacauccugcgcacccaggagagcgagugcgucugcaucaacggcacgugcaccguggugaugaccgacggcuccgccucggagcgggcggacaccaagauccucuucaucgaggaggggaagaucguccacaucucgccccuguccggcagcgcccagcacguggaggagugcuccugcuacccgcgcuaccccggggugcggugcgucugccgcgacaacuggaagggcucgaaccggcccaucguggacaucaacgugaaggacuacuccaucgucagcuccuacgugugcucgggccuggugggggacacgccccgcaagaacgaccgguccucguccagcuacugccgcaacccgaacaacgagaagggcucccacggggucaagggcugggccuucgacgacgggaacgacguguggaugggccggaccaucggcgaggagcuccgcucgggguacgagaccuucaaggucaucggcgggugguccacccccaacagcaagcugcagaucaaccgccaggugaucguggacuccggcaaccggucgggguacuccggcaucuucucggucgagggcaagagcugcaucaaccggugcuucuacguggagcugauccgcgggcgcgagcaggagacgcgggugugguggaccuccaacucgaucgucguguucugcggcaccuccgggaccuacggcacggggagcuggcccgacggcgccgacaucaaccucaugcccaucuga

SEQ ID NO: 24980 - RNA, 1410 nt, Artificial Sequence; identical to SEQ ID NO: 17215
  derived and/or modified CDS sequence (AUadapt) from InfluenzaA__AFM72112__NA

SEQ ID NO: 24981 - RNA, 1410 nt, Artificial Sequence
  derived and/or modified CDS sequence (AUadapt) from InfluenzaA__AFM72123__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacucgauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggucguccucguccugccacgacggcaaggccuggcuccacgugugcgugaccgggcacgacaagaacgcgaccgccagcuucaucuacgacggccggcuggucgacuccaucgggucgugguccaagaacauccugcgcacccaggagagcgagugcgugugcaucaacggcacgugcaccguggucaugaccgacggcuccgccucggagcgggccgacaccaagauccucuucaucgaggaggggaagaucgugcacaucucgccccuguccggcagcgcgcagcacguggaggagugcuccugcuacccgcgcuaccccgggguccggugcgugugccgcgacaacuggaagggcucgaaccggcccaucguggacaucaacgucaaggacuacuccaucgugagcuccuacgugugcucgggccuggucggggacacgccccgcaagaacgaccgguccucguccagcuacugccgcaacccgaacaacgagaagggcucccacggggugaagggcugggccuucgacgacgggaacgacgucuggaugggccggaccaucggcgaggagcuccgcucgggguacgagaccuucaaggugaucggcgggugguccacccccaacagcaagcugcagacgaaccgccaggugaucgucgacuccggcaaccggucgggguacuccggcaucuucucgguggagggcaagagcugcaucaaccggugcuucuacguggagcugauccgcgggcgcgagcaggagacccgggucugguggaccuccaacucgaucgugguguucugcggcaccuccgggacguacggcaccgggagcuggcccgacggcgccgacaucaaccucaugcccaucuga

SEQ ID NO: 24982 - RNA, 1410 nt, Artificial Sequence; identical to SEQ ID NO: 24537
  derived and/or modified CDS sequence (AUadapt) from InfluenzaA__AFM72134__NA

SEQ ID NO: 24983 - RNA, 1410 nt, Artificial Sequence
  derived and/or modified CDS sequence (AUadapt) from InfluenzaA__AFM72145__NA
augaaccccaaccagaagaucaucaccaucggcucggugucccugaccaucgccacgaucugcuuccucaugcagaucgccauccuggcgaucaccgucacccugcacuucaagcaguacgagugcaacucgccgcccaacaaccaggugaugcucugcgagcccaccaucaucgagcgcaacacgaccgagaucguguaccugaccaacaccacgaucgagaaggaggucugccccaagcuggccgaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgcgugguccucguccucgugccacgacggcaaggccuggcugcacgugugcgugaccgggcacgacgagaacgccaccgccuccuucaucuacgacggccggcugguggacagcaucggguccuggucgaagaacauccuccgcacccaggaguccgagugcgucugcaucaacggcacgugcaccguggugaugaccgacggcagcgcguccgagcgggccgacaccaagauccuguucaucgaggaggggaagaucguccacaucucgccccugucgggcuccgcccagcacguggaggagugcagcugcuacccccgcuacccgggggugcggugcgucugccgcgacaacuggaagggcuccaaccggcccaucguggacaucaacgugaaggacuacucgaucgucuccagcuacgugugcuccggccucgugggggacacgccccgcaagaacgacucguccucguccagcuacugccggaaccccaacaacgagaagggcucccacggggucaagggcugggccuucgacgacgggaacgacguguggaugggccgcaccaucucggaggagcugcgguccggcuacgagaccuucaaggucaucgggggcuggagcaagccgaacuccaagcugcagaucaaccgccaggugaucguggaccgggggaaccgcucgggcuacuccgggaucuucucggucgagggcaagagcugcaucaaccggugcuucuacguggagcucauccgcggccgcaagcaggagaccgaggugugguggacguccaacucgaucgucguguucugcgggaccuccggcaccuacgggaccggcagcuggcccgacggggccgacaucaaccugaugcccaucuga

SEQ ID NO: 24984 - RNA, 1410 nt, Artificial Sequence; identical to SEQ ID NO: 17587
  derived and/or modified CDS sequence (AUadapt) from InfluenzaA__AFM72156__NA

SEQ ID NO: 24985 - RNA, 1410 nt, Artificial Sequence
  derived and/or modified CDS sequence (AUadapt) from InfluenzaA__AFM72167__NA
augaaccccaaccagaagaucaucaccaucggcucgaucucccugaccaucgccacgaucugcuuccucaugcagaucgccauccuggugaccaccgucacccugcacuucaagcaguacgagugcaacucgccgcccaacaaccaggugaugcucugcgagcccacgaucaucgagcgcaacaucaccgagaucguguaccugaccaacaccacgaucgagaaggagaucugccccgagcuggcggaguaccggaacugguccaagccgcagugcaagaucaccggguucgcccccuucagcaaggacaacuccauccgccucucggccggcggggacaucugggucacccgggagcccuacguguccugcgaccccggcaagugcuaccaguucgcccuggggcagggcaccacgcugaacaaccgccacagcaacgacaccgugcacgaccggaccccguaccgcacccuccugaugaacgagcugggcguccccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggagcaagaacauccuccgcacccaggaguccgagugcgugugcaucaacggcacgugcaccgucgugaugaccgacggcucggccuccgagcgggcggacaccaagauccuguucaucgaggaggggaagaucgugcacaucagcccccugucgggcuccgcccagcacgucgaggagugcucgugcuacccccgcuacccgggggugcggugcgugugccgcgacaacuggaagggcuccaaccggcccaucgucgacaucaacgugaaggacuacagcaucguguccucguacgucugcuccggccucgugggggacacgccccgcaagaacgacagcuccucguccagcuacugcuggaaccccaacaacgagaagggcgggcacggcgugaaggggugggccuucgacgacggcaacgacgucuggaugggccggaccaucuccgaggagcugcgcucgggguacgagaccuucaaggugaucggcgggugguccaagccgaacagcaagcugcagaucaaccggcaggucaucguggaccgcggcaaccgguccggguacucgggcaucuucuccguggagggcaagagcugcaucaaccgcugcuucuacgucgagcucauccgggggcgcaagcaggagaccgaggugugguggacgucgaacuccaucguggucuucugcggcaccagcgggaccuacggcaccggguccuggcccgacggcgccgacaucaaccugaugcccaucuga

SEQ ID NO: 24986 - RNA, 1410 nt, Artificial Sequence
  derived and/or modified CDS sequence (AUadapt) from InfluenzaA__AFM72178__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccgagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggagcaagaacauccuccgcacccaggaguccgagugcgucugcaucaacggcacgugcaccguggugaugaccgacggcucggccuccgagcgggcggacaccaagauccuguucaucgaggaggggaagaucguccacaucagcccccugucgggcuccgcccagcacguggaggagugcucgugcuacccccgcuacccgggggugcggugcgucugccgcgacaacuggaagggcuccaaccggcccaucguggacaucaacgugaaggacuacagcaucgucuccucguacgugugcuccggccucgugggggacacgccccgcaagaacgacagcuccucguccagcuacugcuggaaccccaacaacgagaagggcgggcacggcgucaaggggugggccuucgacgacggcaacgacguguggaugggccggaccaucuccgaggagcugcgcucgggguacgagaccuucaaggucaucggcgggugguccaagccgaacagcaagcugcagaucaaccgccaggugaucguggaccggggcaaccgguccggguacucgggcaucuucuccgucgagggcaagagcugcaucaaccgcugcuucuacguggagcucauccgggggcgcaagcaggagaccgaggugugguggacgucgaacuccaucgucguguucugcggcaccagcgggaccuacggcaccggguccuggcccgacggcgccgacaucaaccugaugcccaucuga

SEQ ID NO: 24987 - RNA, 1410 nt, Artificial Sequence
  derived and/or modified CDS sequence (AUadapt) from InfluenzaA__AFM72189__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccucguccucgugccacgacgggaaggcguggcugcacgugugcgugaccggccacgacgagaacgccaccgccuccuucaucuacgacgggcggcugguggacagcaucggcuccuggucgaagaagauccuccgcacccaggaguccgagugcgucugcaucaacgggacgugcaccguggugaugaccgacggcagcgccuccggccgggcggacaccaagauccuguucaucgaggaggggaagaucguccacaucucgccccugcucggcagcgcccagcacguggaggagugcuccugcuacccccgcuacccgggggugcggugcgucugccgcgacaacuggaagggcucgaaccggcccaucguggacaucaacgugaaggacuacuccaucgucucguccuacgugugcagcggccuggugggggacacgccccgcaagaacgacuccucguccagcucccacugccugaaccccaacaacgaggagggcgggcacggcgucaaggggugggccuucgacgacggcgacgacguguggaugggccggaccaucucggagaagcuccgcuccggguacgagaccuucaaggucaucgagggcuggucgaagccgaacuccaagcugcagaucaaccgccaggugaucguggaccgggggaaccggagcggcuacuccgggaucuucucggucgagggcaaguccugcaucaaccgcugcuucuacguggagcugauccggggccgcaagcaggagaccgaggugugguggacgagcaacucgaucgucguguucugcgggaccuccggcaccuacgggaccggcagcuggcccgacggggccgacaucaaccucaugcccaucuga

SEQ ID NO: 24988 - RNA, 1410 nt, Artificial Sequence; identical to SEQ ID NO: 24987
  derived and/or modified CDS sequence (AUadapt) from InfluenzaA__AFM72200__NA

SEQ ID NO: 24989 - RNA, 1410 nt, Artificial Sequence; identical to SEQ ID NO: 18151
  derived and/or modified CDS sequence (AUadapt) from InfluenzaA__AFM72211__NA

SEQ ID NO: 24990 - RNA, 1410 nt, Artificial Sequence; identical to SEQ ID NO: 18151
  derived and/or modified CDS sequence (AUadapt) from InfluenzaA__AFM72222__NA

SEQ ID NO: 24991 - RNA, 1413 nt, Artificial Sequence; identical to SEQ ID NO: 18855
  derived and/or modified CDS sequence (AUadapt) from InfluenzaA__AFM72233__NA

SEQ ID NO: 24992 - RNA, 1410 nt, Artificial Sequence; identical to SEQ ID NO: 16975
  derived and/or modified CDS sequence (AUadapt) from InfluenzaA__AFM72249__NA

SEQ ID NO: 24993 - RNA, 1410 nt, Artificial Sequence; identical to SEQ ID NO: 16463
  derived and/or modified CDS sequence (AUadapt) from InfluenzaA__AFM72260__NA

SEQ ID NO: 24994 - RNA, 1410 nt, Artificial Sequence; identical to SEQ ID NO: 16463
  derived and/or modified CDS sequence (AUadapt) from InfluenzaA__AFM72271__NA

SEQ ID NO: 24995 - RNA, 1410 nt, Artificial Sequence
  derived and/or modified CDS sequence (AUadapt) from InfluenzaA__AFM72293__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacuacaccguccacgaccgcaccccguaccggacccuccugaugaacgagcugggcgugcccuuccaccucgggacgaagcaggucugcaucgccugguccucguccagcugccacgacggcaaggcguggcugcacgugugcgugaccggggacgacgagaacgccaccgccuccuucaucuacaacggccgccugguggacucgaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgagccuguccgggucggcccagcacguggaggagugcuccugcuacccccgcuaccccggcgugcggugcgucugccgcgacaacuggaagggcagcaaccggccgaucguggacaucaacgugaaggacuacuccaucgucucguccuacgugugcagcgggcucgugggcgacacgccccgcaagaacgacuccucguccucgucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggucgaagcccaacuccaagcuccagaucaaccgccaggugaucguggaccggggcaaccggagcggguacuccggcaucuucucggucgagggcaagagcugcaucaaccgcugcuucuacguggagcugauccgggggcgcaagcaggagaccgaggugcuguggaccuccaacucgaucgucguguucugcggcaccuccgggaccuacggcacggggagcuggccggacggcgccgacaucaaccucaugcccaucuga

SEQ ID NO: 24996 - RNA, 1410 nt, Artificial Sequence; identical to SEQ ID NO: 18331
  derived and/or modified CDS sequence (AUadapt) from InfluenzaA__AFM72304__NA

SEQ ID NO: 24997 - RNA, 1410 nt, Artificial Sequence
  derived and/or modified CDS sequence (AUadapt) from InfluenzaA__AFM72315__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacgagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgagaagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccgggacaaccggucgggcuacuccgggaucuucagcgucgagggcaagucgugcaucaaccgcugcuucuacguggagcucauccgggggcgcaaccaggagaccgaggugcuguggaccuccaacagcaucgucguguucugcggcaccuccggcacguacgggaccggcagcuggccggacggggccgacaucaaccugaugcccaucuga

SEQ ID NO: 24998 - RNA, 1410 nt, Artificial Sequence
  derived and/or modified CDS sequence (AUadapt) from InfluenzaA__AFM72326__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggucguccagcuccugccacgacgggaaggccuggcuccacgugugcgugaccggcgacgacgagaacgcgaccgccucguucaucuacaacgggcgccugguggacuccaucgucagcugguccaagaagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcucgggccuggugggcgacacgccccgcaagaacgacuccagcuccucgucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaaguuccagaucaaccgccaggugaucguggaccgggacaaccggucgggcuacuccgggaucuucagcgucgagggcaagucgugcaucaaccgcugcuucuacguggagcugauccgggggcgcaaccaggagaccgaggugcucuggaccuccaacagcaucgucguguucugcggcaccuccggcacguacgggaccggcagcuggccggacggggccgacaucaaccugaugcccaucuga

SEQ ID NO: 24999 - RNA, 1410 nt, Artificial Sequence
  derived and/or modified CDS sequence (AUadapt) from InfluenzaA__AFM72337__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggaccggggcaaccgcuccggguacucgggcaucuucuccgucgagggcaagagcugcaucaaccggugcuucuacguggagcucauccgcgggcggaaggaggagaccgaggugcuguggaccucgaacuccaucgucguguucugcggcacgagcgggaccuacggcaccggguccuggccggacggcgccgaccugaaccucaugcccaucuga

SEQ ID NO: 25000 - RNA, 1410 nt, Artificial Sequence
  derived and/or modified CDS sequence (AUadapt) from InfluenzaA__AFM72348__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcauccccuuccaccucgggacgcgccaggugugcaucgccugguccagcuccucgugccacgacggcaaggcguggcugcacgugugcgucaccggggacgacaagaacgccaccgccuccuucaucuacaacggccggcugguggacagcaucggguccuggucgaagaagauccuccgcacccaggaguccgagugcgugugcaucaacggcacgugcaccgucgugaugaccgacggcucggccuccgggaaggcggacaccaagauccuguucaucgaggagggcaagaucgugcacaucagcacgcugucgggguccgcccagcacgucgaggagugcucgugcuacccccgguaccccggcgugcgcugcgugugccgggacaacuggaagggcuccaaccgcccgaucgucgacaucaacgugaaggacuacagcaucguguccucguacgucugcuccgggcucgugggcgacacgccccggaagaacgacagcuccucguccucgcacugccuggaccccaacaacgaggagggcgggcacggggugaagggcugggccuucgacgacggcaacgacgucuggauggggcgcaccaucuccgagaagcugcggagcggcuacgagaccuucaaggugaucgaggggugguccaagcccaacucgaagcuccagaucaaccgccaggucaucguggagcggggcaaccgcuccggguacucgggcaucuucuccguggagggcaagagcugcaucaaccggugcuucuacgucgagcugauccgcgggcggaaggaggagaccgaggugugguggaccucgaacuccaucguggucuucugcggcaccagcgggaccuacggcacgggguccuggccggacggcgccgacaucaaccugaugcccaucuga

SEQ ID NO: 25001 - RNA, 1410 nt, Artificial Sequence
  derived and/or modified CDS sequence (AUadapt) from InfluenzaA__AFM72359__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccaaggugcuguggaccuccaacagcaucgucguguucugcggcaccuccgggacguacggcaccgggagcuggccggacggcgccgacaucaaccugaugcccaucuga

SEQ ID NO: 25002 - RNA, 1410 nt, Artificial Sequence; identical to SEQ ID NO: 25001
  derived and/or modified CDS sequence (AUadapt) from InfluenzaA__AFM72370__NA

SEQ ID NO: 25003 - RNA, 1410 nt, Artificial Sequence; identical to SEQ ID NO: 21920
  derived and/or modified CDS sequence (AUadapt) from InfluenzaA__AFM72381__NA

SEQ ID NO: 25004 - RNA, 1410 nt, Artificial Sequence; identical to SEQ ID NO: 21920
  derived and/or modified CDS sequence (AUadapt) from InfluenzaA__AFM72392__NA

SEQ ID NO: 25005 - RNA, 1410 nt, Artificial Sequence; identical to SEQ ID NO: 18804
  derived and/or modified CDS sequence (AUadapt) from InfluenzaA__AFM72403__NA

SEQ ID NO: 25006 - RNA, 1410 nt, Artificial Sequence; identical to SEQ ID NO: 18804
  derived and/or modified CDS sequence (AUadapt) from InfluenzaA__AFM72414__NA

SEQ ID NO: 25007 - RNA, 1410 nt, Artificial Sequence; identical to SEQ ID NO: 18468
  derived and/or modified CDS sequence (AUadapt) from InfluenzaA__AFM72425__NA

SEQ ID NO: 25008 - RNA, 1410 nt, Artificial Sequence; identical to SEQ ID NO: 18468
  derived and/or modified CDS sequence (AUadapt) from InfluenzaA__AFM72436__NA

SEQ ID NO: 25009 - RNA, 1410 nt, Artificial Sequence; identical to SEQ ID NO: 18468
  derived and/or modified CDS sequence (AUadapt) from InfluenzaA__AFM72447__NA

SEQ ID NO: 25010 - RNA, 1410 nt, Artificial Sequence; identical to SEQ ID NO: 18468
  derived and/or modified CDS sequence (AUadapt) from InfluenzaA__AFM72458__NA

SEQ ID NO: 25011 - RNA, 1410 nt, Artificial Sequence; identical to SEQ ID NO: 18468
  derived and/or modified CDS sequence (AUadapt) from InfluenzaA__AFM72469__NA

SEQ ID NO: 25012 - RNA, 1410 nt, Artificial Sequence
  derived and/or modified CDS sequence (AUadapt) from InfluenzaA__AFM72491__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugaugugcgagcccacgaucaucgagcgcaacaucaccgagaucguguaccugaccaacaccacgaucgagaaggagaucugccccaagcucgccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccugggccaggggaccacgcucaacaacgugcacuccaacgacaccguccgcgaccggaccccguaccgcacccugcugaugaacgagcucggcgugcccuuccaccugggcacgaagcaggucugcaucgccuggagcuccucguccugccacgacgggaaggccuggcugcacgugugcaucaccggcgacgacaagaacgcgaccgccagcuucaucuacaacgggcggcucguggacuccaucgugucgugguccaaggagauccugcgcacccaggagagcgagugcgucugcaucaacggcacgugcaccguggugaugaccgacggguccgccucgggcaaggccgacaccaagauccuguucaucgaggagggcaagaucguccacacgagcacccucuccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccuggaccccaacaacgaggagggcgggcacggggugaagggcugggccuucgacgacgggaacgacgucuggaugggccgcaccaucucggagaagucccggcucggcuacgagaccuucaaggugaucgagggguggagcaaccccaacuccaagcugcagaucaaccgccaggucaucguggaccggggcaaccgcucgggguacuccggcaucuucagcguggagggcaagucgugcaucaaccggugcuucuacgucgagcugauccgcgggcggaaggaggagaccgaggugcucuggaccuccaacagcaucguggucuucugcggcaccuccgggacguacggcaccgggagcuggccggacggcgccgacaucaaccugaugcccaucuga

SEQ ID NO: 25013 - RNA, 1410 nt, Artificial Sequence; identical to SEQ ID NO: 25012
  derived and/or modified CDS sequence (AUadapt) from InfluenzaA__AFM72502__NA

SEQ ID NO: 25014 - RNA, 1413 nt, Artificial Sequence; identical to SEQ ID NO: 19034
  derived and/or modified CDS sequence (AUadapt) from InfluenzaA__AFM72513__NA

SEQ ID NO: 25015 - RNA, 1413 nt, Artificial Sequence; identical to SEQ ID NO: 19034
  derived and/or modified CDS sequence (AUadapt) from InfluenzaA__AFM72524__NA

SEQ ID NO: 25016 - RNA, 1413 nt, Artificial Sequence; identical to SEQ ID NO: 19034
  derived and/or modified CDS sequence (AUadapt) from InfluenzaA__AFM72535__NA

SEQ ID NO: 25017 - RNA, 1413 nt, Artificial Sequence; identical to SEQ ID NO: 19034
  derived and/or modified CDS sequence (AUadapt) from InfluenzaA__AFM72546__NA

SEQ ID NO: 25018 - RNA, 1413 nt, Artificial Sequence; identical to SEQ ID NO: 19034
  derived and/or modified CDS sequence (AUadapt) from InfluenzaA__AFM72557__NA

SEQ ID NO: 25019 - RNA, 1410 nt, Artificial Sequence; identical to SEQ ID NO: 16383
  derived and/or modified CDS sequence (AUadapt) from InfluenzaA__AFM72579__NA

SEQ ID NO: 25020 - RNA, 1413 nt, Artificial Sequence
  derived and/or modified CDS sequence (AUadapt) from InfluenzaA__AFM72802__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaugugcaaccagcgcaucaucaccuacgagaacuccaccugggugaaccacaccuacgucaacaucaacaacacgaacgugguggcggggaaggacaagaccccggucacccuggccggcaacucgucccugugcagcaucuccggcugggccauccacaccaaggacaacagcauccggaucggguccaagggcgacguguucgugauccgcgagcccuucaucucgugcucccaccucgagugcaagacguucuuccugacccagggggcccugcucaacgacaagcacagcaacggcaccgucaaggaccggucccccuaccgcgcccugaugucgugcccccugggggaggcgccgucccccuacaacagcaaguucgagucgguggccugguccgccagcgccugccacgacggcaucggcuggcucaccaucgggaucuccggccccgacaacggggcgguggccguccugaaguacaacggcaucaucacgggcaccaucaagagcuggaagaagcagauccugcggacccaggaguccgagugcgugugcaugaacgggucgugcuucaccaucaugacggacggccccuccaacggggccgccagcuacaagaucuucaagaucgagaagggcaaggugaucaaguccauggagcucaacgccccgaacuuccacuacgaggagugcucgugcuaccccgacaccgggaccgucaugugcgugugccgcgacaacuggcacggcuccaaccggcccugggugagcuucaaccagaaccuggacuaccagaucggcuacaucugcuccggggucuucggcgacaacccccgcccggaggacggggagggcucgugcaaccccgugaccguggacggggcgaacggcgucaagggcuucuccuacaaguacgggaacggcguguggaucgggcggaccaagagcaaccgcauccggaagggcuucgagaugaucugggaccccaacggguggacgaacaccgacuccgacuucagcgugaagcaggacaucgucgccaucaccgacugguccggcuacucgggcagcuucgugcagcaccccgagcugacggggcucgacugcauccgcccgugcuucuggguggagcugguccggggccugccccgcgagaacaccaccaucuggaccuccgggucguccaucagcuucugcggcgugaacuccgacaucgccaacuggagcuggcccgacggcgccgagcuccccuucacgaucgacaaguga

SEQ ID NO: 25021 - RNA, 1413 nt, Artificial Sequence; identical to SEQ ID NO: 25020
  derived and/or modified CDS sequence (AUadapt) from InfluenzaA__AFM72813__NA

SEQ ID NO: 25022 - RNA, 1413 nt, Artificial Sequence; identical to SEQ ID NO: 25020
  derived and/or modified CDS sequence (AUadapt) from InfluenzaA__AFM72824__NA

SEQ ID NO: 25023 - RNA, 1410 nt, Artificial Sequence; identical to SEQ ID NO: 16274
  derived and/or modified CDS sequence (AUadapt) from InfluenzaA__AFM72835__NA

SEQ ID NO: 25024 - RNA, 1410 nt, Artificial Sequence; identical to SEQ ID NO: 16274
  derived and/or modified CDS sequence (AUadapt) from InfluenzaA__AFM72845__NA

SEQ ID NO: 25025 - RNA, 1410 nt, Artificial Sequence; identical to SEQ ID NO: 16274
  derived and/or modified CDS sequence (AUadapt) from InfluenzaA__AFM72855__NA

SEQ ID NO: 25026 - RNA, 1410 nt, Artificial Sequence; identical to SEQ ID NO: 16274
  derived and/or modified CDS sequence (AUadapt) from InfluenzaA__AFM72865__NA

SEQ ID NO: 25027 - RNA, 1410 nt, Artificial Sequence
  derived and/or modified CDS sequence (AUadapt) from InfluenzaA__AFM72875__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaaguccgacagcuccagcuccucgcacugccucgaccccaacaacgaggagggcgggcacggggucaagggcugggccuucgacgacgggaacgacguguggaugggccgcaccaucuccgagaagucccggcugggcuacgagaccuucaaggucaucgagggguggagcaaccccaagucgaagcugcagaucaaccgccaggugaucguggaccggggcaaccgcuccggguacagcggcaucuucucggucgaggggaaguccugcaucaaccggugcuucuacguggagcucauccgcggccggaaggaggagaccgaggugcuguggaccagcaacuccaucgucguguucugcggcaccagcgggacguacggcaccggguccuggccggacggcgccgacaucaaccugaugcccguguga

SEQ ID NO: 25028 - RNA, 1410 nt, Artificial Sequence; identical to SEQ ID NO: 19001
  derived and/or modified CDS sequence (AUadapt) from InfluenzaA__AFM72886__NA

SEQ ID NO: 25029 - RNA, 1410 nt, Artificial Sequence; identical to SEQ ID NO: 19001
  derived and/or modified CDS sequence (AUadapt) from InfluenzaA__AFM72897__NA

SEQ ID NO: 25030 - RNA, 1410 nt, Artificial Sequence
  derived and/or modified CDS sequence (AUadapt) from InfluenzaA__AFM72908__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaccaaggaccacuccaucgucagcuccuacgugugcucgggccuggugggcgacacgccccggaagaacgacuccagcuccucgucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggucgaaccccaaguccaagcugcagaucaaccgccaggugaucguggaccggggcaaccgcagcggguacuccggcaucuucucggucgagggcaagagcugcaucaaccggugcuucuacguggagcucauccgcgggcggaaggaggagaccgaggugcuguggaccuccaacucgaucgucguguucugcggcacguccgggaccuacggcaccgggagcuggccggacggcgccgacaucaaccugaugcccguguga

SEQ ID NO: 25031 - RNA, 1410 nt, Artificial Sequence
  derived and/or modified CDS sequence (AUadapt) from InfluenzaA__AFM72919__NA
augaaccccaaccagaagaucaucaccaucggcucggugucccugaccaucucgacgaucugcuucuucaugcagaucgccauccucaucaccaccgucacccugcacuucaagcagcacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaccaaggaccacuccaucgucucguccuacgugugcagcggccuggugggcgacacgccccggaagaacgacuccucguccucgucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggucgaaccccaaguccaagcugcagaucaaccgccaggugaucguggaccggggcaaccgcagcggguacuccggcaucuucucggucgagggcaagagcugcaucaaccggugcuucuacguggagcucauccgcgggcggaaggaggagaccgaggugcuguggaccuccaacucgaucgucguguucugcggcacguccgggaccuacggcaccgggagcuggccggacggcgccgacaucaaccugaugcccguguga

SEQ ID NO: 25032 - RNA, 1410 nt, Artificial Sequence; identical to SEQ ID NO: 20307
  derived and/or modified CDS sequence (AUadapt) from InfluenzaA__AFM72930__NA

SEQ ID NO: 25033 - RNA, 1410 nt, Artificial Sequence; identical to SEQ ID NO: 20307
  derived and/or modified CDS sequence (AUadapt) from InfluenzaA__AFM72941__NA

SEQ ID NO: 25034 - RNA, 1410 nt, Artificial Sequence; identical to SEQ ID NO: 20307
  derived and/or modified CDS sequence (AUadapt) from InfluenzaA__AFM72952__NA

SEQ ID NO: 25035 - RNA, 1410 nt, Artificial Sequence; identical to SEQ ID NO: 20307
  derived and/or modified CDS sequence (AUadapt) from InfluenzaA__AFM72963__NA

SEQ ID NO: 25036 - RNA, 1410 nt, Artificial Sequence; identical to SEQ ID NO: 20307
  derived and/or modified CDS sequence (AUadapt) from InfluenzaA__AFM72974__NA

SEQ ID NO: 25037 - RNA, 1410 nt, Artificial Sequence; identical to SEQ ID NO: 21920
  derived and/or modified CDS sequence (AUadapt) from InfluenzaA__AFM72985__NA

SEQ ID NO: 25038 - RNA, 1410 nt, Artificial Sequence; identical to SEQ ID NO: 21920
  derived and/or modified CDS sequence (AUadapt) from InfluenzaA__AFM72996__NA

SEQ ID NO: 25039 - RNA, 1410 nt, Artificial Sequence; identical to SEQ ID NO: 21920
  derived and/or modified CDS sequence (AUadapt) from InfluenzaA__AFM73007__NA

SEQ ID NO: 25040 - RNA, 1410 nt, Artificial Sequence
  derived and/or modified CDS sequence (AUadapt) from InfluenzaA__AFM73018__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgucagcuccaacggggccaacggcgugaagggguucagcuucaaguacggcaacgggaucuggaucggccgcaccaagagcaucuccagccggaagggcuucgagaugaucugggaccccaacggguggaccggcaccgacaacaacuucuccaucaagcaggacaucguggggaucaacgaguggucgggcuacuccgggagcuucguccagcacccggagcugacgggccuggacugcauccgccccugcuucuggguggagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 25041 - RNA, 1410 nt, Artificial Sequence; identical to SEQ ID NO: 25040
  derived and/or modified CDS sequence (AUadapt) from InfluenzaA__AFM73028__NA

SEQ ID NO: 25042 - RNA, 1410 nt, Artificial Sequence; identical to SEQ ID NO: 25040
  derived and/or modified CDS sequence (AUadapt) from InfluenzaA__AFM73038__NA

SEQ ID NO: 25043 - RNA, 1410 nt, Artificial Sequence; identical to SEQ ID NO: 20875
  derived and/or modified CDS sequence (AUadapt) from InfluenzaA__AFM73048__NA

SEQ ID NO: 25044 - RNA, 1410 nt, Artificial Sequence
  derived and/or modified CDS sequence (AUadapt) from InfluenzaA__AFM73058__NA
augaaccccaaccagaagaucaucaccaucggcucguucugcaugaccaucgggcuggccaaccucauccugcagaucggcaacaucaucuccaucuggaucagccacuccauccagcuggggaaccagaaccagaucgagacgugcaaccagagcgugaucaccuacgagaacaacaccugggucaaccagaccuacgugaacaucuccaacacgaacuucgccgcgggccagagcguggucuccgugaagcucgccgggaacagcucccugugcccggugucgggcugggccaucuacuccaaggacaacagcguccgcaucggcuccaagggggacguguucgugauccgggagcccuucaucagcugcagcccccuggagugccgcaccuucuuccucacccagggcgcccugcugaacgacaagcacuccaacgggaccaucaaggaccggucccccuaccgcacgcucaugagcugcccgaucggcgagguccccucccccuacaacagccgguucgagucgguggccugguccgcgagcgccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccuggaguaccggaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucucgucccgcaacggcuucgagaugaucugggaccccaacggguggaccggcaccgacaagaacuucagcaucaagcaggacaucguggggaucaacgagugguccggcuacagcggguccuucgugcagcacccggagcugacgggccucgacugcauccggcccugcuucugggucgagcugauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 25045 - RNA, 1410 nt, Artificial Sequence; identical to SEQ ID NO: 20875
  derived and/or modified CDS sequence (AUadapt) from InfluenzaA__AFM73068__NA

SEQ ID NO: 25046 - RNA, 1413 nt, Artificial Sequence; identical to SEQ ID NO: 17353
  derived and/or modified CDS sequence (AUadapt) from InfluenzaA__AFM73480__NA

SEQ ID NO: 25047 - RNA, 1350 nt, Artificial Sequence; identical to SEQ ID NO: 16404
  derived and/or modified CDS sequence (AUadapt) from InfluenzaA__AFM78569__NA

SEQ ID NO: 25048 - RNA, 1410 nt, Artificial Sequence
  derived and/or modified CDS sequence (AUadapt) from InfluenzaA__AFM85180__NA
augaaccccaaccagaagaucaucaccaucggcucggugucccugaccaucgccacgaucugcuuccucacccagaucgccauccuggucaccaccgugacgcugcacuucaagcaguacgagugcaacucguccccgaacaaccaggugaugcucugcgagcccaccaucaucgagcgcaacaucaccgagaucgucuaccugaccaacacgaccaucgagaaggagaucugccccaagcuggcggaguaccggaacuggagcaagccccagugcaacaucaccggguucgccccguucuccaaggacaacucgauccgccucuccgccggcggggacaucugggugacccgggagcccuacgugagcugcggccccgacaagugcuaccaguucgcccuggggcagggcacgacccugaacaacggccacuccaacgacaccguccacgaccgcacccccuaccggacgcuccugaugaacgagcugggggugccguuccaccucggcaccaagcaggucugcaucgccuggucguccucguccugccacgacgggaaggcguggcugcacgugugcgugaccggcgacgacaagaacgccaccgccagcuucaucuacaacgggcgccugguggacuccaucggcucgugguccaagaagauccuccggacgcaggagagcgagugcgucugcaucaacgggaccugcaccguggugaugaccgacggguccgccucgggcaaggcggacacgaagauccuguucaucgaggaggggaagaucguccacaccucgcugcucuccggcagcgcccagcacguggaggagugcuccugcuacccccgcuaccccggcgugcggugcgucugccgcgacaacuggaaggggucgaaccggcccaucguggacaucaacgugaaggacuacuccaucgucagcuccuacgugugcucgggccuggugggggacaccccgcgcaagaacgacuccucguccagcucccacugccuggaccccaacaacgaggagggcgggcacggcgucaagggcugggccuucgacgacgggaacgacguguggaugggccggaccaucucggagaagcuccgcuccggguacgagacguucaaggucaucgagggcuggagcaagcccaacuccaagcugcagaucaaccgccaggugaucguggaccgggggaaccggucgggcuacuccggcaucuucucggucgagggcaagagcugcaucaaccgcugcuucuacguggagcugauccggggccgcaaccaggagaccgaggugcucuggaccuccaacucgaucgucguguucugcgggaccuccggcacguacgggaccggcagcuggcccgacggcgccgacaucaaccugaugccgaucuga

SEQ ID NO: 25049 - RNA, 1410 nt, Artificial Sequence; identical to SEQ ID NO: 16505
  derived and/or modified CDS sequence (AUadapt) from InfluenzaA__AFN11830__NA

SEQ ID NO: 25050 - RNA, 1410 nt, Artificial Sequence
  derived and/or modified CDS sequence (AUadapt) from InfluenzaA__AFN11831__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccucguccagcugccacgacggcaaggcguggcuccacgucugcgugacgggguacgacaagaacgccaccgccuccuucaucuacgacggccggcugguggacucgaucggguccuggucgaagaacauccugcgcacccaggaguccgagugcgucugcaucaacgggaccugcacgguggugaugaccgacggcagcgccuccggccgggcggacaccaagauccucuucaucgaggagggcaagaucguccacaucucgccccugagcggguccgcccagcacguggaggagugcucgugcuacccccgcuacccgggcgugcggugcgucugccgcgacaacuggaagggcuccaaccggcccgugguggacaucaacgucaaggacuacagcaucguguccucguacgugugcuccgggcuggucggcgacacgccccgcaacaacgaccggagcuccucguccuacugccgcaaccccaacaacgagaaggggaaccacggcgugaaggggugggccuucgacgacggcaacgacgucuggaugggccggaccaucucggaggagucccgcagcggguacgagaccuucaaggugaucggcgggugguccaccccgaacucgaagcuccagaucaaccgccaggugaucgucgacuccgacaaccggagcggcuacuccgggaucuucucgguggagggcaagagcugcaucaaccggugcuucuacguggagcugauccgcggccgcgagcaggagacccgggucugguggacguccaacucgaucgugguguucugcgggaccuccggcaccuacgggaccggcagcuggcccgacggggccgacaucaaccugaugcccaucuga

SEQ ID NO: 25051 - RNA, 1410 nt, Artificial Sequence; identical to SEQ ID NO: 16978
  derived and/or modified CDS sequence (AUadapt) from InfluenzaA__AFN11833__NA

SEQ ID NO: 25052 - RNA, 1410 nt, Artificial Sequence; identical to SEQ ID NO: 18913
  derived and/or modified CDS sequence (AUadapt) from InfluenzaA__AFN11835__NA

SEQ ID NO: 25053 - RNA, 1410 nt, Artificial Sequence
  derived and/or modified CDS sequence (AUadapt) from InfluenzaA__AFN11836__NA
augaaccccaaccagaagaucaucaccaucggcucggugucccugaccaucgccacgaugugcuuccucaugcagaucgccauccuggucaccaccgugacccugcacuucaagcaguacgagugcucguccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacucgauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggucguccagcuccugccacgacggcaaggccuggcuccacgugugcgugaccgggcacgacaagaacgcgaccgccucguucaucuacgacggccggcuggucgacuccaucgggucgugguccaagaacauccugcgcacccaggagagcgagugcgugugcaucaacggcacgugcaccguggucaugaccgacggcuccgccucggagcgggccgacaccaagauccucuucaucgaggaggggaagaucauccacaucagcccccuguccggcucggcgcagcacguggaggagugcuccugcuacccgcgcuaccccggggugcggugcgucugccgcgacaacuggaagggcagcaaccggcccaucguggacaucaacgugaaggacuacuccaucgucucguccuacgugugcagcggccuggugggggacacgccccgcaagaacgaccgguccucguccucguacugccgcaacccgaacaacgagaagggcucccacggggucaagggcugggccuucgacgacgggaacgacguguggaugggccggaccaucggcgaggagcuccgcagcggguacgagaccuucaaggucaucggcgggugguccacccccaacucgaagcugcagaucaaccgccaggugaucguggacuccggcaaccggagcggguacuccggcaucuucucggucgagggcaagagcugcaucaaccggugcuucuacguggagcugauccgcgggcgcgagcaggagacgcgggugugguggaccuccaacucgaucgucguguucugcggcaccuccgggaccuacggcacggggagcuggcccgacggcgccgacaucaaccucaugcccaucuga

SEQ ID NO: 25054 - RNA, 1410 nt, Artificial Sequence
  derived and/or modified CDS sequence (AUadapt) from InfluenzaA__AFN11839__NA
augaaccccaaccagaagaucaucaccaucggcucggugucccugaccaucgccacgaucugcuuccucaugcagaucgccauccuggucaccaccgugacccugcacuucaagcaguacgagugcagcuccccgcccaacaaccaggugaugcccugccagcccacgaucaucgagcgcaacaucaccgagaucgucuaccucaccaacaccacgaucgagaaggagaucugcccgaagcugguggaguaccggaacuggucgaagccccagugcaagaucaccggguucgcgcccuucuccaaggacaacagcauccgccuguccgccggcggggacaucugggugacccgggagcccuacgucucgugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggagcuccucguccugccacgacggcaaggccuggcuccacgugugcgugaccgggcacgacgagaacgcgaccgccagcuucaucuacgacggccggcuggucgacuccaucgggucgugguccaagaacauccugcgcacccaggagagcgagugcgugugcaucaacggcacgugcaccguggucaugaccgacggcuccgccucggagcgggccgacaccaagauccucuucaucgaggaggggaagaucgugcacaucagcccccuguccggcucggcgcagcacguggaggagugcuccugcuacccgcgcuaccccgggguccggugcgugugccgcgacaacuggaagggcagcaaccggcccaucguggacaucaacaugaaggacuacuccaucgucucguccuacgugugcagcggccuggugggggacacgccccgcaagaacgacuccucguccagcuccuacugccggaacccgaacaacgagaagggcucgcacggggucaagggcugggccuucgacgacgggaacgacguguggaugggccgcaccaucuccgaggagcuccggagcggcuacgagaccuucaaggucaucgggggcugguccacccccaacucgaagcugcagaucaaccgccaggugaucguggacuccgggaaccggagcggcuacucggggaucuucuccgucgagggcaagagcugcaucaaccgcugcuucuacguggagcugauccggggccgcaagcaggagacgaaggugugguggaccuccaacucgaucgucguguucugcgggaccuccggcaccuacgggacgggcagcuggcccgacggggccgacaucaaccucaugcccaucuga

SEQ ID NO: 25055 - RNA, 1410 nt, Artificial Sequence
  derived and/or modified CDS sequence (AUadapt) from InfluenzaA__AFN11840__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccucgugccacgacggcaaggcguggcugcacgugugcgugaccgggcacgacgagaacgccaccgccuccuucaucuacgacggccggcugguggacagcaucggguccuggucgaagaacauccuccgcacccaggaguccgagugcgucugcaucaacggcacgugcaccguggugaugaccgacggcagcgccuccgagcgggcggacaccaagauccuguucaucgaggaggggaagaucguccacaucucgccccugagcggcuccgcccagcacguggaggagugcucgugcuacccccgcuacccgggggugcggugcgucugccgcgacaacuggaagggcuccaaccggcccaucguggacaucaacgugaaggacuacucgaucgucuccagcuacgugugcuccggccucgugggggacacgccccgcaagaacgacucguccagcuccucguacugccggaaccccaacaacgagaagggcucccacggggucaagggcugggccuucgacgacgggaacgacguguggaugggccgcaccaucggcgaggagcugcggucgggguacgagaccuucaaggucaucggcgggugguccaccccgaacagcaagcugcagaucaaccgccaggugaucguggaccggggcaaccgcuccggguacucgggcaucuucuccgucgagggcaagagcugcaucaaccggugcuucuacguggagcucgugcgcgggcgcaagcaggagacggaggucugguggaccucgaacuccaucgugguguucugcggcaccagcgggaccuacggcacgggguccuggcccgacggcgccgacaucaaccugaugcccaucuga

SEQ ID NO: 25056 - RNA, 1410 nt, Artificial Sequence; identical to SEQ ID NO: 18331
  derived and/or modified CDS sequence (AUadapt) from InfluenzaA__AFN11841__NA

SEQ ID NO: 25057 - RNA, 1410 nt, Artificial Sequence; identical to SEQ ID NO: 24419
  derived and/or modified CDS sequence (AUadapt) from InfluenzaA__AFN11842__NA

SEQ ID NO: 25058 - RNA, 1410 nt, Artificial Sequence
  derived and/or modified CDS sequence (AUadapt) from InfluenzaA__AFN11844__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcggcugguggacuccaucgucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaucaaggacuacuccaucgucagcuccuacgugugcucgggccuggugggcgacacgccccggaagaacgacuccagcuccagcucccacugccucgaccccaacaacgaggagggcgggcacggggucaagggcugggccuucgacgacgggaacgacguguggaugggccgcaccaucucggagaagcugcgguccggcuacgagaccuucaaggucaucgagggguggagcaaccccaacuccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucgggcugaugcccauguga

SEQ ID NO: 25059 - RNA, 1410 nt, Artificial Sequence; identical to SEQ ID NO: 24978
  derived and/or modified CDS sequence (AUadapt) from InfluenzaA__AFN11845__NA

SEQ ID NO: 25060 - RNA, 1410 nt, Artificial Sequence; identical to SEQ ID NO: 24506
  derived and/or modified CDS sequence (AUadapt) from InfluenzaA__AFN11847__NA

SEQ ID NO: 25061 - RNA, 1410 nt, Artificial Sequence
  derived and/or modified CDS sequence (AUadapt) from InfluenzaA__AFN11848__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacgagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgggcccaacaacgaggagggcgggcacggcgucaaggggugggccuucgacgacggcaacgacguguggaugggccggaccaucucggagaagcugcgcuccggguacgagaccuucaaggucaucgagggcuggagcaaccccaacuccaagcugcagaucaaccgccaggugaucguggaccgggggaaccggucgggcuacuccgggaucuucagcgucgagggcaagucgugcaucaaccgcugcuucuacguggagcucauccggggccgcaagcaggagaccgaggugcuguggaccuccaacagcaucgucguguucugcgggaccuccggcacguacgggaccggcagcuggccggacggggccgacaucaaccugaugcccaucuga

SEQ ID NO: 25062 - RNA, 1410 nt, Artificial Sequence
  derived and/or modified CDS sequence (AUadapt) from InfluenzaA__AFN11850__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcggccggaccccguaccgcacccugcucaugaacgagcugggcgugcccuuccaccuggggacgaagcaggucugcaucgccuggagcuccucguccugccacgacggcaaggccuggcuccacgugugcaucaccggggacgacaagaacgcgaccgccagcuucaucuacaacggccggcugguggacuccguggucucgugguccaaggagauccugcgcacccaggagagcgagugcgugugcaucaacgggacgugcaccguggucaugaccgacggcuccgccucgggcaaggccgacaccaagauccucuucaucgaggaggggaagaucgugcacacgagcacccuguccggcucggcgcagcacguggaggagugcuccugcuacccccgguaccccgggguccgcugcgugugccgggacaacuggaagggcagcaaccgcccgaucguggacaucaacaucaaggaccacuccaucgucucguccuacgugugcagcggccuggugggggacacgccccggaagaacgacuccucguccagcucccacugccucgaccccaacaacgaggagggcgggcacggcgucaaggggugggccuucgacgacggcaacgacguguggaugggccgcaccaucucggagaagucccggcugggguacgagaccuucaaggucaucgagggcuggagcaaccacaaguccaagcugcagaucaaccgccaggugaucguggaccgggggaaccgcucgggcuacuccgggaucuucagcgucgagggcaagucgugcaucaaccggugcuucuacguggagcucauccgcggccggaaggaggagaccgaggugcuguggaccuccaacagcaucgucguguucugcgggaccuccggcacguacgggaccggcagcuggcccgacggggccgaccugaaccucaugccgaucuga

SEQ ID NO: 25063 - RNA, 1410 nt, Artificial Sequence
  derived and/or modified CDS sequence (AUadapt) from InfluenzaA__AFN11851__NA
augaaccccaaccagaagaucaucaccaucggcucggugucccugaccaucgccacgaucugccuccugaugcagaucgccauccuggucaccaccgugacccuccacuucaagcaguacgagugcaacucgccgcccaacaaccaggugaugcugugcgagcccacgaucaucgagcgcaacaucaccaagaucgucuaccugaccaacaccacgaucgagaaggagaucugccccaagcucgcggaguaccggaacugguccaagccgcagugcaagaucaccggguucgcccccuucagcaaggacaacuccauccgccugucggccggcggggacaucugggugacccgggagcccuacguguccugcgaccccggcaagugcuaccaguucgcccuggggcagggcaccacgcucaacaaccgccacagcaacgacaccguccacgaccggaccccguaccgcacccugcugaugaacgagcucggcgugcccuuccaccuggggacgaagcaggucugcaucgccugguccucguccucgugccacgacggcaaggcguggcugcacgugugcgugaccgggcacgacgagaacgccaccgccuccuucaucuacgacggccggcucguggacagcaucggguccuggucgaagaacauccugcgcacccaggaguccgagugcgucugcaucaacggcacgugcaccguggugaugaccgacggcagcgccuccgagcgggcggacaccaagauccuguucaucgaggaggggaagaucguccacaucucgccccucucgggcuccgcccagcacguggaggagugcagcugcuacccccgcuacccgggggugcggugcgucugccgcgacaacuggaagggcuccaaccggcccaucguggacaucaacgugaaggacuacucgaucgucuccagcuacgugugcuccggccuggugggggacacgccccgcaagaacgacucguccucguccagcuacugccggaaccccaacaacgagaagggcucccacggggucaagggcugggccuucgacgacgggaacgacguguggaugggccgcaccaucucggaggagcugcgguccggcuacgagaccuucaaggucaucgggggcuggagcaagccgaacuccaagcuccagaucaaccgccaggugaucguggaccgggggaaccgcucgggcuacuccgggaucuucucggucgagggcaagagcugcaucaaccggugcuucuacguggagcugauccgcggccgcaagcaggagaccgaggugugguggacguccaacucgaucgucguguucugcgggaccuccggcaccuacgggaccggcagcuggcccgacggggccgacaucaaccugaugcccaucuga

SEQ ID NO: 25064 - RNA, 1410 nt, Artificial Sequence; identical to SEQ ID NO: 16729
  derived and/or modified CDS sequence (AUadapt) from InfluenzaA__AFN11853__NA

SEQ ID NO: 25065 - RNA, 1410 nt, Artificial Sequence
  derived and/or modified CDS sequence (AUadapt) from InfluenzaA__AFN11855__NA
augaaccccaaccagaagaucaucaccaucggcucggugucccugaccaucagcacgaucugcuucuucaugcagaccgccauccucaucaccaucgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcgccugguggacuccaucgugagcugguccaaggagauccugcggacccaggagucggagugcgucugcaucaacggcacgugcaccguggugaugaccgacggguccgccagcggcaaggccgacaccaagauccucuucaucgaggagggcaagaucguccacacgucgauccuguccgggagcgcgcagcacguggaggagugcuccugcuacccccgcuaccccggcgugcggugcgucugccgcgacaacuggaaggggucgaaccggccgaucguggacaucaacaucaaggaccacuccaucgugagcuccuacgucugcucgggccuggugggcgacacgccccgcaagaacgacuccagcuccagcucccacugccucgaccccaacaacgaggagggcgggcacggggugaagggcugggccuucgacgacgggaacgacgucuggaugggccggaccaucucggagaagucccgccugggcuacgagaccuucaaggugaucgagggguggagcaaccccaaguccaagcugcagaucaaccggcaggucaucguggaccgcggcaaccggucgggguacuccggcaucuucagcguggagggcaagucgugcaucaaccgcugcuucuacgucgagcucauccgggggcgcaaggaggagaccgaggugcuguggaccuccaacagcaucguggucuucugcggcaccuccgggaccuacggcacggggagcuggccggacggcgccgacaucaaccugaugcccaucuga

SEQ ID NO: 25066 - RNA, 1410 nt, Artificial Sequence; identical to SEQ ID NO: 18331
  derived and/or modified CDS sequence (AUadapt) from InfluenzaA__AFN11857__NA

SEQ ID NO: 25067 - RNA, 1410 nt, Artificial Sequence; identical to SEQ ID NO: 16318
  derived and/or modified CDS sequence (AUadapt) from InfluenzaA__AFN17373__NA

SEQ ID NO: 25068 - RNA, 1410 nt, Artificial Sequence; identical to SEQ ID NO: 24773
  derived and/or modified CDS sequence (AUadapt) from InfluenzaA__AFN17383__NA

SEQ ID NO: 25069 - RNA, 1410 nt, Artificial Sequence; identical to SEQ ID NO: 16318
  derived and/or modified CDS sequence (AUadapt) from InfluenzaA__AFN17393__NA

SEQ ID NO: 25070 - RNA, 1410 nt, Artificial Sequence; identical to SEQ ID NO: 16318
  derived and/or modified CDS sequence (AUadapt) from InfluenzaA__AFN17403__NA

SEQ ID NO: 25071 - RNA, 1410 nt, Artificial Sequence; identical to SEQ ID NO: 16318
  derived and/or modified CDS sequence (AUadapt) from InfluenzaA__AFN17413__NA

SEQ ID NO: 25072 - RNA, 1410 nt, Artificial Sequence; identical to SEQ ID NO: 16318
  derived and/or modified CDS sequence (AUadapt) from InfluenzaA__AFN17423__NA

SEQ ID NO: 25073 - RNA, 1410 nt, Artificial Sequence; identical to SEQ ID NO: 16318
  derived and/or modified CDS sequence (AUadapt) from InfluenzaA__AFN17433__NA

SEQ ID NO: 25074 - RNA, 1410 nt, Artificial Sequence; identical to SEQ ID NO: 16318
  derived and/or modified CDS sequence (AUadapt) from InfluenzaA__AFN17443__NA

SEQ ID NO: 25075 - RNA, 1410 nt, Artificial Sequence; identical to SEQ ID NO: 16318
  derived and/or modified CDS sequence (AUadapt) from InfluenzaA__AFN17453__NA

SEQ ID NO: 25076 - RNA, 1410 nt, Artificial Sequence; identical to SEQ ID NO: 16318
  derived and/or modified CDS sequence (AUadapt) from InfluenzaA__AFN17459__NA

SEQ ID NO: 25077 - RNA, 1410 nt, Artificial Sequence; identical to SEQ ID NO: 16318
  derived and/or modified CDS sequence (AUadapt) from InfluenzaA__AFN17469__NA

SEQ ID NO: 25078 - RNA, 1410 nt, Artificial Sequence; identical to SEQ ID NO: 16318
  derived and/or modified CDS sequence (AUadapt) from InfluenzaA__AFN17479__NA

SEQ ID NO: 25079 - RNA, 1410 nt, Artificial Sequence; identical to SEQ ID NO: 16318
  derived and/or modified CDS sequence (AUadapt) from InfluenzaA__AFN17489__NA

SEQ ID NO: 25080 - RNA, 1410 nt, Artificial Sequence; identical to SEQ ID NO: 16318
  derived and/or modified CDS sequence (AUadapt) from InfluenzaA__AFN17499__NA

SEQ ID NO: 25081 - RNA, 1410 nt, Artificial Sequence; identical to SEQ ID NO: 16318
  derived and/or modified CDS sequence (AUadapt) from InfluenzaA__AFN17509__NA

SEQ ID NO: 25082 - RNA, 1410 nt, Artificial Sequence; identical to SEQ ID NO: 16318
  derived and/or modified CDS sequence (AUadapt) from InfluenzaA__AFN17519__NA

SEQ ID NO: 25083 - RNA, 1410 nt, Artificial Sequence; identical to SEQ ID NO: 16318
  derived and/or modified CDS sequence (AUadapt) from InfluenzaA__AFN17529__NA

SEQ ID NO: 25084 - RNA, 1410 nt, Artificial Sequence; identical to SEQ ID NO: 16318
  derived and/or modified CDS sequence (AUadapt) from InfluenzaA__AFN17539__NA

SEQ ID NO: 25085 - RNA, 1410 nt, Artificial Sequence; identical to SEQ ID NO: 16318
  derived and/or modified CDS sequence (AUadapt) from InfluenzaA__AFN17549__NA

SEQ ID NO: 25086 - RNA, 1410 nt, Artificial Sequence; identical to SEQ ID NO: 16318
  derived and/or modified CDS sequence (AUadapt) from InfluenzaA__AFN17559__NA

SEQ ID NO: 25087 - RNA, 1410 nt, Artificial Sequence; identical to SEQ ID NO: 16318
  derived and/or modified CDS sequence (AUadapt) from InfluenzaA__AFN17569__NA

SEQ ID NO: 25088 - RNA, 1410 nt, Artificial Sequence; identical to SEQ ID NO: 16318
  derived and/or modified CDS sequence (AUadapt) from InfluenzaA__AFN17575__NA

SEQ ID NO: 25089 - RNA, 1410 nt, Artificial Sequence; identical to SEQ ID NO: 16318
  derived and/or modified CDS sequence (AUadapt) from InfluenzaA__AFN17581__NA

SEQ ID NO: 25090 - RNA, 1410 nt, Artificial Sequence; identical to SEQ ID NO: 16318
  derived and/or modified CDS sequence (AUadapt) from InfluenzaA__AFN17587__NA

SEQ ID NO: 25091 - RNA, 1410 nt, Artificial Sequence; identical to SEQ ID NO: 16318
  derived and/or modified CDS sequence (AUadapt) from InfluenzaA__AFN17597__NA

SEQ ID NO: 25092 - RNA, 1410 nt, Artificial Sequence; identical to SEQ ID NO: 24773
  derived and/or modified CDS sequence (AUadapt) from InfluenzaA__AFN17607__NA

SEQ ID NO: 25093 - RNA, 1410 nt, Artificial Sequence; identical to SEQ ID NO: 16318
  derived and/or modified CDS sequence (AUadapt) from InfluenzaA__AFN17617__NA

SEQ ID NO: 25094 - RNA, 1410 nt, Artificial Sequence; identical to SEQ ID NO: 16318
  derived and/or modified CDS sequence (AUadapt) from InfluenzaA__AFN17627__NA

SEQ ID NO: 25095 - RNA, 1410 nt, Artificial Sequence; identical to SEQ ID NO: 16318
  derived and/or modified CDS sequence (AUadapt) from InfluenzaA__AFN17637__NA

SEQ ID NO: 25096 - RNA, 1410 nt, Artificial Sequence; identical to SEQ ID NO: 16318
  derived and/or modified CDS sequence (AUadapt) from InfluenzaA__AFN17647__NA

SEQ ID NO: 25097 - RNA, 1410 nt, Artificial Sequence; identical to SEQ ID NO: 16318
  derived and/or modified CDS sequence (AUadapt) from InfluenzaA__AFN17657__NA

SEQ ID NO: 25098 - RNA, 1410 nt, Artificial Sequence; identical to SEQ ID NO: 16318
  derived and/or modified CDS sequence (AUadapt) from InfluenzaA__AFN17667__NA

SEQ ID NO: 25099 - RNA, 1410 nt, Artificial Sequence; identical to SEQ ID NO: 16318
  derived and/or modified CDS sequence (AUadapt) from InfluenzaA__AFN17677__NA

SEQ ID NO: 25100 - RNA, 1410 nt, Artificial Sequence; identical to SEQ ID NO: 24773
  derived and/or modified CDS sequence (AUadapt) from InfluenzaA__AFN17687__NA

SEQ ID NO: 25101 - RNA, 1410 nt, Artificial Sequence; identical to SEQ ID NO: 16318
  derived and/or modified CDS sequence (AUadapt) from InfluenzaA__AFN17697__NA

SEQ ID NO: 25102 - RNA, 1410 nt, Artificial Sequence; identical to SEQ ID NO: 24773
  derived and/or modified CDS sequence (AUadapt) from InfluenzaA__AFN17707__NA

SEQ ID NO: 25103 - RNA, 1410 nt, Artificial Sequence; identical to SEQ ID NO: 16318
  derived and/or modified CDS sequence (AUadapt) from InfluenzaA__AFN17717__NA

SEQ ID NO: 25104 - RNA, 1410 nt, Artificial Sequence; identical to SEQ ID NO: 24773
  derived and/or modified CDS sequence (AUadapt) from InfluenzaA__AFN17727__NA

SEQ ID NO: 25105 - RNA, 1410 nt, Artificial Sequence; identical to SEQ ID NO: 16318
  derived and/or modified CDS sequence (AUadapt) from InfluenzaA__AFN17737__NA

SEQ ID NO: 25106 - RNA, 1410 nt, Artificial Sequence; identical to SEQ ID NO: 16318
  derived and/or modified CDS sequence (AUadapt) from InfluenzaA__AFN17743__NA

SEQ ID NO: 25107 - RNA, 1410 nt, Artificial Sequence; identical to SEQ ID NO: 24773
  derived and/or modified CDS sequence (AUadapt) from InfluenzaA__AFN17749__NA

SEQ ID NO: 25108 - RNA, 1410 nt, Artificial Sequence; identical to SEQ ID NO: 16318
  derived and/or modified CDS sequence (AUadapt) from InfluenzaA__AFN17759__NA

SEQ ID NO: 25109 - RNA, 1410 nt, Artificial Sequence; identical to SEQ ID NO: 16318
  derived and/or modified CDS sequence (AUadapt) from InfluenzaA__AFN17769__NA

SEQ ID NO: 25110 - RNA, 1410 nt, Artificial Sequence; identical to SEQ ID NO: 16318
  derived and/or modified CDS sequence (AUadapt) from InfluenzaA__AFN17775__NA

SEQ ID NO: 25111 - RNA, 1410 nt, Artificial Sequence
  derived and/or modified CDS sequence (AUadapt) from InfluenzaA__AFN17785__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucacccucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccuggaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacacguucucgaucaagcaggacaucgucgggaucaacgagugguccggcuacagcggguccuucgugcagcacccggagcugaccggccucgacugcauccgccccugcuucuggguggagcugauccggggccgccccaaggagaacaccaucuggaccagcggguccagcaucuccuucugcggcgucaacagcgacacgguggggugguccuggcccgacggcgccgagcugccguucaccaucgacaaguga

SEQ ID NO: 25112 - RNA, 1410 nt, Artificial Sequence
  derived and/or modified CDS sequence (AUadapt) from InfluenzaA__AFN17795__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucggcggcugggccaucuacagcaaggacaacuccauccgcaucgggagcaagggcgacguguucgugauccgggagcccuucaucuccugcagcccccuggagugccgcaccuucuuccugacccagggggcccuccugaacgacaagcacuccaacggcaccaucaaggaccggucgcccuaccgcacgcugauguccugcccgaucggggagguccccagccccuacaacucccgguucgagagcguggccuggagcgcguccgccugccacgacggcaucaacuggcucaccaucggcaucucggggcccgacaacggcgccguggccguccugaaguacaacgggaucaucaccgacaccaucaaguccuggcgcaacaacauccugcggacgcaggagagcgagugcgcgugcgugaacggcuccugcuucaccgugaugaccgacggcccgagcgacgggcaggccuccuacaagaucuuccgcaucgagaagggcaagaucgucaagagcguggagaugaacgcccccaacuaccacuacgaggagugcuccugcuaccccgacucguccgagaucacgugcgugugccgggacaacuggcacgggagcaaccgccccugggucuccuucaaccagaaccucgaguaccagaucggcuacaucugcagcgggaucuucggcgacaacccgcggcccaacgacaagaccggcuccugcgggcccgugagcuccaacggcgccaacggggugaagggcuucucguucaaguacgggaacggcgucuggaucggccgcaccaaguccaucagcagccggaacggguucgagaugaucugggaccccaacggcuggaccgggaccgacaacaacuucuccaucaagcaggacaucgugggcaucaacgaguggagcggguacuccggcucguucgugcagcacccggagcugacgggccuggacugcauccgccccugcuucugggucgagcucauccgggggcgccccaaggagaacaccaucuggaccuccggcagcuccaucagcuucugcggggugaacuccgacaccgucggcuggagcuggcccgacggcgccgagcugccguucacgaucgacaaguga

SEQ ID NO: 25113 - RNA, 1410 nt, Artificial Sequence; identical to SEQ ID NO: 16318
  derived and/or modified CDS sequence (AUadapt) from InfluenzaA__AFN17805__NA

SEQ ID NO: 25114 - RNA, 1410 nt, Artificial Sequence
  derived and/or modified CDS sequence (AUadapt) from InfluenzaA__AFN17815__NA
augaaccccaaccagaagaucaucaccaucggcucgguguccaugaccaucgggauggccaaccugauccuccagaucggcaacaucaucagcaucuggaucucccacagcauccagcuggggaaccagaaccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcucgccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggucggcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagucgguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugucguccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 25115 - RNA, 1410 nt, Artificial Sequence; identical to SEQ ID NO: 16318
  derived and/or modified CDS sequence (AUadapt) from InfluenzaA__AFN17825__NA

SEQ ID NO: 25116 - RNA, 1410 nt, Artificial Sequence; identical to SEQ ID NO: 24773
  derived and/or modified CDS sequence (AUadapt) from InfluenzaA__AFN17835__NA

SEQ ID NO: 25117 - RNA, 1410 nt, Artificial Sequence; identical to SEQ ID NO: 16318
  derived and/or modified CDS sequence (AUadapt) from InfluenzaA__AFN17845__NA

SEQ ID NO: 25118 - RNA, 1410 nt, Artificial Sequence; identical to SEQ ID NO: 16318
  derived and/or modified CDS sequence (AUadapt) from InfluenzaA__AFN17855__NA

SEQ ID NO: 25119 - RNA, 1410 nt, Artificial Sequence; identical to SEQ ID NO: 20954
  derived and/or modified CDS sequence (AUadapt) from InfluenzaA__AFN17865__NA

SEQ ID NO: 25120 - RNA, 1410 nt, Artificial Sequence; identical to SEQ ID NO: 24773
  derived and/or modified CDS sequence (AUadapt) from InfluenzaA__AFN17875__NA

SEQ ID NO: 25121 - RNA, 1410 nt, Artificial Sequence; identical to SEQ ID NO: 24773
  derived and/or modified CDS sequence (AUadapt) from InfluenzaA__AFN17885__NA

SEQ ID NO: 25122 - RNA, 1410 nt, Artificial Sequence; identical to SEQ ID NO: 16318
  derived and/or modified CDS sequence (AUadapt) from InfluenzaA__AFN17895__NA

SEQ ID NO: 25123 - RNA, 1410 nt, Artificial Sequence; identical to SEQ ID NO: 24773
  derived and/or modified CDS sequence (AUadapt) from InfluenzaA__AFN17905__NA

SEQ ID NO: 25124 - RNA, 1410 nt, Artificial Sequence; identical to SEQ ID NO: 16318
  derived and/or modified CDS sequence (AUadapt) from InfluenzaA__AFN17911__NA

SEQ ID NO: 25125 - RNA, 1410 nt, Artificial Sequence; identical to SEQ ID NO: 24773
  derived and/or modified CDS sequence (AUadapt) from InfluenzaA__AFN17921__NA

SEQ ID NO: 25126 - RNA, 1410 nt, Artificial Sequence
  derived and/or modified CDS sequence (AUadapt) from InfluenzaA__AFN17931__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcucccgcggggacguguucgugauccgggagcccuucaucagcugcagcccccuggagugccggaccuucuuccugacccagggcgcccuccugaacgacaagcacuccaacgggaccaucaaggaccgcucccccuaccggacgcugaugucgugcccgaucggcgagguccccucccccuacaacagccgcuucgagagcguggccugguccgcgagcgccugccacgacgggaucaacuggcucaccaucggcaucuccggccccgacaacggggccguggccguccugaaguacaacggcaucaucaccgacaccaucaagagcuggcggaacaacauccugcgcacgcaggaguccgagugcgcgugcgugaacgggucgugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucucguucaaccagaaccucgaguaccgcaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 25127 - RNA, 1410 nt, Artificial Sequence; identical to SEQ ID NO: 16318
  derived and/or modified CDS sequence (AUadapt) from InfluenzaA__AFN17941__NA

SEQ ID NO: 25128 - RNA, 1410 nt, Artificial Sequence; identical to SEQ ID NO: 16318
  derived and/or modified CDS sequence (AUadapt) from InfluenzaA__AFN17951__NA

SEQ ID NO: 25129 - RNA, 1410 nt, Artificial Sequence
  derived and/or modified CDS sequence (AUadapt) from InfluenzaA__AFN17961__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaacuccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 25130 - RNA, 1410 nt, Artificial Sequence; identical to SEQ ID NO: 16318
  derived and/or modified CDS sequence (AUadapt) from InfluenzaA__AFN17971__NA

SEQ ID NO: 25131 - RNA, 1410 nt, Artificial Sequence; identical to SEQ ID NO: 16318
  derived and/or modified CDS sequence (AUadapt) from InfluenzaA__AFN17981__NA

SEQ ID NO: 25132 - RNA, 1410 nt, Artificial Sequence; identical to SEQ ID NO: 16318
  derived and/or modified CDS sequence (AUadapt) from InfluenzaA__AFN17991__NA

SEQ ID NO: 25133 - RNA, 1410 nt, Artificial Sequence
  derived and/or modified CDS sequence (AUadapt) from InfluenzaA__AFN18001__NA
augaaccccaaccagaagaucaucaccaucucguccgugugcaugaccaucggcauggccaaccugauccuccagaucgggaacaucaucagcaucuggaucucccacagcauccagcugggcaaccagaaccagaucgagacgugcaaccaguccgucaucaccuacgagaacaacaccugggugaaccagaccuacgugaacaucagcaacacgaacuucgccgcggggcaguccgucgugucggugaagcuggccggcaacuccagccucugcccggucuccgggugggccaucuacagcaaggacaacuccauccgcaucggcagcaagggcgacguguucgugauccgggagcccuucaucuccugcagcccccuggagugccgcaccuucuuccugacccagggggcccuccugaacgacaagcacuccaacggcaccaucaaggaccggucgcccuaccgcacgcugauguccugcccgaucggggagguccccagccccuacaacagccgguucgaguccguggccuggagcgcguccgccugccacgacggcaucaacuggcucaccaucgggaucagcggccccgacaacggcgccguggccguccugaaguacaacgggaucaucaccgacaccaucaaguccuggcgcaacaacauccugcggacgcaggagucggagugcgcgugcgugaacggcuccugcuucacccucaugaccgacgggccgagcgacggccaggccuccuacaagaucuuccgcaucgagaagggcaagaucgucaagagcguggagaugaacgcccccaacuaccacuacgaggagugcuccugcuaccccgacagcuccgagaucacgugcgugugccgggacaacuggcacgggagcaaccgccccuggguguccuucaaccagaaccuggaguaccagaucggcuacaucugcucggggaucuucggcgacaacccgcggcccaacgacaagaccggguccugcggccccgucagcuccaacggcgccaacggggugaagggcuucagcuucaaguacgggaacggcguguggaucgggcgcaccaagagcaucuccagccggaacggcuucgagaugaucugggaccccaacggcuggaccgggaccgacaacaacuucuccaucaagcaggacaucgucggcaucaacgaguggucgggguacuccggcagcuucgugcagcacccggagcugacggggcucgacugcauccgccccugcuucuggguggagcugauccggggccgccccaaggagaacaccaucuggaccuccggcagcuccaucagcuucugcggggucaacuccgacaccgugggcuggagcuggcccgacggggccgagcugccguucacgaucgacaaguga

SEQ ID NO: 25134 - RNA, 1410 nt, Artificial Sequence; identical to SEQ ID NO: 16318
  derived and/or modified CDS sequence (AUadapt) from InfluenzaA__AFN18011__NA

SEQ ID NO: 25135 - RNA, 1410 nt, Artificial Sequence; identical to SEQ ID NO: 16318
  derived and/or modified CDS sequence (AUadapt) from InfluenzaA__AFN18021__NA

SEQ ID NO: 25136 - RNA, 1410 nt, Artificial Sequence
  derived and/or modified CDS sequence (AUadapt) from InfluenzaA__AFN18031__NA
augaaccccaaccagaagaucaucaccaucggcucgaucugcaugaccaucgggauggccaaccugauccuccagaucggcaacaucaucuccaucuggaucagccacuccauccagcuggggaaccagaaccagaucgagacgugcaaccagagcgugaucaccuacgagaacaacaccugggucaaccagaccuacgugaacaucuccaacacgaacuucgccgcgggccagagcguggucuccgugaagcuggccgggaacucgucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggucgugcuucacccucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccuggaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccucgacugcauccgccccugcuucuggguggagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 25137 - RNA, 1410 nt, Artificial Sequence; identical to SEQ ID NO: 16318
  derived and/or modified CDS sequence (AUadapt) from InfluenzaA__AFN18041__NA

SEQ ID NO: 25138 - RNA, 1410 nt, Artificial Sequence; identical to SEQ ID NO: 24773
  derived and/or modified CDS sequence (AUadapt) from InfluenzaA__AFN18051__NA

SEQ ID NO: 25139 - RNA, 1410 nt, Artificial Sequence; identical to SEQ ID NO: 24773
  derived and/or modified CDS sequence (AUadapt) from InfluenzaA__AFN18061__NA

SEQ ID NO: 25140 - RNA, 1410 nt, Artificial Sequence; identical to SEQ ID NO: 16318
  derived and/or modified CDS sequence (AUadapt) from InfluenzaA__AFN18070__NA

SEQ ID NO: 25141 - RNA, 1410 nt, Artificial Sequence; identical to SEQ ID NO: 16318
  derived and/or modified CDS sequence (AUadapt) from InfluenzaA__AFN18080__NA

SEQ ID NO: 25142 - RNA, 1410 nt, Artificial Sequence; identical to SEQ ID NO: 16318
  derived and/or modified CDS sequence (AUadapt) from InfluenzaA__AFN18090__NA

SEQ ID NO: 25143 - RNA, 1410 nt, Artificial Sequence; identical to SEQ ID NO: 16318
  derived and/or modified CDS sequence (AUadapt) from InfluenzaA__AFN18100__NA

SEQ ID NO: 25144 - RNA, 1410 nt, Artificial Sequence; identical to SEQ ID NO: 16318
  derived and/or modified CDS sequence (AUadapt) from InfluenzaA__AFN18106__NA

SEQ ID NO: 25145 - RNA, 1410 nt, Artificial Sequence
  derived and/or modified CDS sequence (AUadapt) from InfluenzaA__AFN18108__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccggaucggguacaucugcuccggcaucuucggggacaacccgcgccccaacgacaagaccggcagcugcggccccgugcuguccaacggggccaacggcgugaagggguucagcuucaaguacggcaacggggucuggaucggccggaccaaguccaucagcagccgcaacggcuucgagaugaucugggaccccaacggguggaccggcaccgacaacaacuucuccaucaagcaggacaucguggggaucaacgaguggucgggcuacuccgggagcuucgugcagcacccggagcugacgggccucgacugcauccggcccugcuucugggucgagcugauccgcggccggcccaaggagaacaccaucuggaccuccgggagcuccaucagcuucugcggcgugaacuccgacaccgucggguggagcuggcccgacggcgccgagcugccguucacgaucgacaaguga

SEQ ID NO: 25146 - RNA, 1410 nt, Artificial Sequence
  derived and/or modified CDS sequence (AUadapt) from InfluenzaA__AFN18118__NA
augaaccccaaccagaagaucaucaccaucggcucggugugcaugaccaucgggauggccaaccugauccuccagaucggcaacaugaucuccaucuggaucagccacuccauccagcuggggaaccagaaccagaucgagacgugcaaccagagcgucaucaccuacgagaacaacaccugggugaaccagaccuacgugaagaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucacccucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccuggaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccucgacugcauccgccccugcuucuggguggagcugauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 25147 - RNA, 1410 nt, Artificial Sequence; identical to SEQ ID NO: 16318
  derived and/or modified CDS sequence (AUadapt) from InfluenzaA__AFN18120__NA

SEQ ID NO: 25148 - RNA, 1410 nt, Artificial Sequence; identical to SEQ ID NO: 16318
  derived and/or modified CDS sequence (AUadapt) from InfluenzaA__AFN18122__NA

SEQ ID NO: 25149 - RNA, 1410 nt, Artificial Sequence; identical to SEQ ID NO: 24773
  derived and/or modified CDS sequence (AUadapt) from InfluenzaA__AFN18128__NA

SEQ ID NO: 25150 - RNA, 1410 nt, Artificial Sequence; identical to SEQ ID NO: 24773
  derived and/or modified CDS sequence (AUadapt) from InfluenzaA__AFN18134__NA

SEQ ID NO: 25151 - RNA, 1410 nt, Artificial Sequence; identical to SEQ ID NO: 16318
  derived and/or modified CDS sequence (AUadapt) from InfluenzaA__AFN18136__NA

SEQ ID NO: 25152 - RNA, 1410 nt, Artificial Sequence; identical to SEQ ID NO: 16318
  derived and/or modified CDS sequence (AUadapt) from InfluenzaA__AFN18138__NA

SEQ ID NO: 25153 - RNA, 1410 nt, Artificial Sequence
  derived and/or modified CDS sequence (AUadapt) from InfluenzaA__AFN18140__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccggaucggguacaucugcuccggcaucuucggggacaacccgcgccccaacgacaagaccggcagcugcggccccguguccagcaacggggccaacggcgugaagggguucuccuucaaguacggcaacgggaucuggaucggccggaccaagagcaucagcucccgcaacggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 25154 - RNA, 1410 nt, Artificial Sequence; identical to SEQ ID NO: 16318
  derived and/or modified CDS sequence (AUadapt) from InfluenzaA__AFN18144__NA

SEQ ID NO: 25155 - RNA, 1410 nt, Artificial Sequence; identical to SEQ ID NO: 16318
  derived and/or modified CDS sequence (AUadapt) from InfluenzaA__AFN18150__NA

SEQ ID NO: 25156 - RNA, 1410 nt, Artificial Sequence; identical to SEQ ID NO: 16318
  derived and/or modified CDS sequence (AUadapt) from InfluenzaA__AFN18156__NA

SEQ ID NO: 25157 - RNA, 1410 nt, Artificial Sequence; identical to SEQ ID NO: 16318
  derived and/or modified CDS sequence (AUadapt) from InfluenzaA__AFN18158__NA

SEQ ID NO: 25158 - RNA, 1410 nt, Artificial Sequence; identical to SEQ ID NO: 20954
  derived and/or modified CDS sequence (AUadapt) from InfluenzaA__AFN18160__NA

SEQ ID NO: 25159 - RNA, 1410 nt, Artificial Sequence
  derived and/or modified CDS sequence (AUadapt) from InfluenzaA__AFN18166__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaagaccugggugaaccagaccuacgugaacaucuccaacgccaacuucgcggccggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugucgugcccgaucggcgagguccccucccccuacaacagcaaguucgagagcguggcgugguccgccagcgccugccacgacgggaucaacuggcucacgaucggcaucuccggccccgacaacggggccguggcgguccugaaguacaacggcaucaucaccgacaccaucaagagcuggcggaacaacauccugcgcacccaggaguccgagugcgccugcgugaacgggucgugcuucacggugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucucguucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucgugcagcacccggagcugaccggccuggacugcauccggcccugcuucugggucgagcucauccgcggccggcccaaggagaacacgaucuggaccagcggguccagcaucuccuucugcggcgugaacagcgacaccgucgggugguccuggcccgacggcgcggagcugccguucaccaucgacaaguga

SEQ ID NO: 25160 - RNA, 1410 nt, Artificial Sequence; identical to SEQ ID NO: 16318
  derived and/or modified CDS sequence (AUadapt) from InfluenzaA__AFN18172__NA

SEQ ID NO: 25161 - RNA, 1410 nt, Artificial Sequence; identical to SEQ ID NO: 20158
  derived and/or modified CDS sequence (AUadapt) from InfluenzaA__AFN18178__NA

SEQ ID NO: 25162 - RNA, 1410 nt, Artificial Sequence
  derived and/or modified CDS sequence (AUadapt) from InfluenzaA__AFN18184__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcauggucuccgugaagcuggccgggaacucgucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggucgugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 25163 - RNA, 1410 nt, Artificial Sequence; identical to SEQ ID NO: 22132
  derived and/or modified CDS sequence (AUadapt) from InfluenzaA__AFN18190__NA

SEQ ID NO: 25164 - RNA, 1410 nt, Artificial Sequence; identical to SEQ ID NO: 23153
  derived and/or modified CDS sequence (AUadapt) from InfluenzaA__AFN18196__NA

SEQ ID NO: 25165 - RNA, 1410 nt, Artificial Sequence
  derived and/or modified CDS sequence (AUadapt) from InfluenzaA__AFN18202__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccgcagcgucguguccgugaagcuggccgggaacucgucccucugcccggucagcggcugggccaucuacuccaaggacaacagcauccggaucggcuccaagggggacguguucgugauccgcgagcccuucaucagcugcagcccccuggagugccggaccuucuuccugacccagggcgcccuccugaacgacaagcacuccaacgggaccaucaaggaccgcucccccuaccggacgcugaugucgugcccgaucggcgagguccccucccccuacaacagccgcuucgagagcguggccugguccgcgagcgccugccacgacgggaucaacuggcucaccaucggcaucuccggccccgacaacggggccguggccguccugaaguacaacggcaucaucaccgacaccaucaagagcuggcggaacaacauccugcgcacgcaggaguccgagugcgcgugcgugaacgggucgugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucucguucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 25166 - RNA, 1410 nt, Artificial Sequence; identical to SEQ ID NO: 16318
  derived and/or modified CDS sequence (AUadapt) from InfluenzaA__AFN18208__NA

SEQ ID NO: 25167 - RNA, 1410 nt, Artificial Sequence
  derived and/or modified CDS sequence (AUadapt) from InfluenzaA__AFN18210__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcgccuucuuccugacccagggcgcccuccugaacgacaagcacuccaacgggaccaucaaggaccggucccccuaccgcacccugaugagcugcccgaucggcgagguccccucccccuacaacagccgguucgagucgguggcgugguccgccagcgccugccacgacgggaucaacuggcucacgaucggcaucuccggccccgacaacggggccguggcgguccugaaguacaacggcaucaucaccgacaccaucaagagcuggcgcaacaacauccugcggacccaggaguccgagugcgccugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccggaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucucgucccgcaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccggcccugcuucugggucgagcucauccgcggccggcugaaggagaacacgaucuggaccagcggguccagcaucuccuucugcggcgugaacagcgacaccgucgggugguccuggcccgacggcgcggagcugcccuucaccaucgacaaguga

SEQ ID NO: 25168 - RNA, 1410 nt, Artificial Sequence; identical to SEQ ID NO: 19723
  derived and/or modified CDS sequence (AUadapt) from InfluenzaA__AFN18216__NA

SEQ ID NO: 25169 - RNA, 1410 nt, Artificial Sequence; identical to SEQ ID NO: 21469
  derived and/or modified CDS sequence (AUadapt) from InfluenzaA__AFN18226__NA

SEQ ID NO: 25170 - RNA, 1410 nt, Artificial Sequence; identical to SEQ ID NO: 16318
  derived and/or modified CDS sequence (AUadapt) from InfluenzaA__AFN18232__NA

SEQ ID NO: 25171 - RNA, 1410 nt, Artificial Sequence; identical to SEQ ID NO: 16318
  derived and/or modified CDS sequence (AUadapt) from InfluenzaA__AFN18234__NA

SEQ ID NO: 25172 - RNA, 1410 nt, Artificial Sequence; identical to SEQ ID NO: 16318
  derived and/or modified CDS sequence (AUadapt) from InfluenzaA__AFN18244__NA

SEQ ID NO: 25173 - RNA, 1410 nt, Artificial Sequence; identical to SEQ ID NO: 16318
  derived and/or modified CDS sequence (AUadapt) from InfluenzaA__AFN18246__NA

SEQ ID NO: 25174 - RNA, 1410 nt, Artificial Sequence; identical to SEQ ID NO: 21469
  derived and/or modified CDS sequence (AUadapt) from InfluenzaA__AFN18256__NA

SEQ ID NO: 25175 - RNA, 1410 nt, Artificial Sequence; identical to SEQ ID NO: 16318
  derived and/or modified CDS sequence (AUadapt) from InfluenzaA__AFN18262__NA

SEQ ID NO: 25176 - RNA, 1410 nt, Artificial Sequence; identical to SEQ ID NO: 16318
  derived and/or modified CDS sequence (AUadapt) from InfluenzaA__AFN18268__NA

SEQ ID NO: 25177 - RNA, 1410 nt, Artificial Sequence; identical to SEQ ID NO: 16318
  derived and/or modified CDS sequence (AUadapt) from InfluenzaA__AFN18270__NA

SEQ ID NO: 25178 - RNA, 1410 nt, Artificial Sequence; identical to SEQ ID NO: 22129
  derived and/or modified CDS sequence (AUadapt) from InfluenzaA__AFN18272__NA

SEQ ID NO: 25179 - RNA, 1410 nt, Artificial Sequence; identical to SEQ ID NO: 16318
  derived and/or modified CDS sequence (AUadapt) from InfluenzaA__AFN18274__NA

SEQ ID NO: 25180 - RNA, 1410 nt, Artificial Sequence; identical to SEQ ID NO: 16318
  derived and/or modified CDS sequence (AUadapt) from InfluenzaA__AFN18282__NA

SEQ ID NO: 25181 - RNA, 1410 nt, Artificial Sequence; identical to SEQ ID NO: 16318
  derived and/or modified CDS sequence (AUadapt) from InfluenzaA__AFN18304__NA

SEQ ID NO: 25182 - RNA, 1410 nt, Artificial Sequence
  derived and/or modified CDS sequence (AUadapt) from InfluenzaA__AFN18306__NA
augaaccccaaccagaagaucaucaccaucggcucggugugcaugaccaucgggaucgccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 25183 - RNA, 1410 nt, Artificial Sequence
  derived and/or modified CDS sequence (AUadapt) from InfluenzaA__AFN18308__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaagggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 25184 - RNA, 1410 nt, Artificial Sequence
  derived and/or modified CDS sequence (AUadapt) from InfluenzaA__AFN18314__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaagaccaucuggaccagcggguccagcaucuccuucugcggcgugaacagcgacaccgucgggugguccuggcccgacggcgccgagcugccguucacgaucgacaaguga

SEQ ID NO: 25185 - RNA, 1410 nt, Artificial Sequence; identical to SEQ ID NO: 16318
  derived and/or modified CDS sequence (AUadapt) from InfluenzaA__AFN18320__NA

SEQ ID NO: 25186 - RNA, 1410 nt, Artificial Sequence
  derived and/or modified CDS sequence (AUadapt) from InfluenzaA__AFN18326__NA
augaaccccaaccagaagaucaucaccaucggcucggugugcaugaccaucgggauggccaaccugcuccugcagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcucgccgggaacucgucccugugcccggucagcggcugggccaucuacuccaaggacaacagcauccgcaucggcuccaagggggacguguucgugauccgggagcccuucaucagcugcagcccccuggagugccgcaccuucuuccucacccagggcgcccugcugaacgacaagcacuccaacgggaccaucaaggaccggucccccuaccgcacgcucaugucgugcccgaucggcgagguccccucccccuacaacagccgguucgagagcguggccugguccgcgagcgccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 25187 - RNA, 1410 nt, Artificial Sequence; identical to SEQ ID NO: 16318
  derived and/or modified CDS sequence (AUadapt) from InfluenzaA__AFN18336__NA

SEQ ID NO: 25188 - RNA, 1410 nt, Artificial Sequence; identical to SEQ ID NO: 16318
  derived and/or modified CDS sequence (AUadapt) from InfluenzaA__AFN18346__NA

SEQ ID NO: 25189 - RNA, 1410 nt, Artificial Sequence; identical to SEQ ID NO: 24773
  derived and/or modified CDS sequence (AUadapt) from InfluenzaA__AFN18356__NA

SEQ ID NO: 25190 - RNA, 1410 nt, Artificial Sequence
  derived and/or modified CDS sequence (AUadapt) from InfluenzaA__AFN18366__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcggagcagagcgucguguccgugaagcuggccggcaacucgucccucugcccggucagcgggugggccaucuacuccaaggacaacagcauccgcaucggcuccaagggcgacguguucgugauccgggagcccuucaucagcugcagcccccuggagugccgcaccuucuuccugacccagggggcccuccugaacgacaagcacuccaacggcaccaucaaggaccggucccccuaccgcacgcugaugucgugcccgaucggggagguccccucccccuacaacagccgguucgagagcguggccugguccgcgagcgccugccacgacggcaucaacuggcucaccaucgggaucuccggccccgacaacggcgccguggccguccugaaguacaacgggaucaucaccgacaccaucaagagcuggcgcaacaacauccugcggacgcaggaguccgagugcgcgugcgugaacggcucgugcuucaccgugaugaccgacgggccguccgacggccaggccagcuacaagaucuuccgcaucgagaagggcaagaucgucaaguccguggagaugaacgcccccaacuaccacuacgaggagugcagcugcuaccccgacuccagcgaggugaccugcgucugccgggacaacuggcacggguccaaccgccccugggugucguucaaccagaaccucgaguaccagaucggcuacaucugcuccgggaucuucggcgacaacccgcggcccaacgacaagacggggagcugcggccccguguccagcaacggcgccaacggggucaagggcuucuccuucaaguacgggaacggcguguggaucgggcgcaccaagagcaucagcucccggaacggcuucgagaugaucugggaccccaacggcuggaccgggaccgacaacaacuucucgaucaagcaggacaucgugggcaucaacgagugguccggguacagcggcuccuucguccagcacccggagcugacggggcuggacugcauccgccccugcuucuggguggagcucauccggggccgccccaaggagaacaccaucuggaccagcggcuccagcaucuccuucugcggggucaacagcgacaccgugggcugguccuggcccgacggggccgagcugccguucacgaucgacaaguga

SEQ ID NO: 25191 - RNA, 1410 nt, Artificial Sequence; identical to SEQ ID NO: 24773
  derived and/or modified CDS sequence (AUadapt) from InfluenzaA__AFN18376__NA

SEQ ID NO: 25192 - RNA, 1410 nt, Artificial Sequence; identical to SEQ ID NO: 16318
  derived and/or modified CDS sequence (AUadapt) from InfluenzaA__AFN18382__NA

SEQ ID NO: 25193 - RNA, 1410 nt, Artificial Sequence; identical to SEQ ID NO: 16318
  derived and/or modified CDS sequence (AUadapt) from InfluenzaA__AFN18392__NA

SEQ ID NO: 25194 - RNA, 1410 nt, Artificial Sequence; identical to SEQ ID NO: 16318
  derived and/or modified CDS sequence (AUadapt) from InfluenzaA__AFN18402__NA

SEQ ID NO: 25195 - RNA, 1410 nt, Artificial Sequence; identical to SEQ ID NO: 16318
  derived and/or modified CDS sequence (AUadapt) from InfluenzaA__AFN18412__NA

SEQ ID NO: 25196 - RNA, 1410 nt, Artificial Sequence; identical to SEQ ID NO: 16318
  derived and/or modified CDS sequence (AUadapt) from InfluenzaA__AFN18422__NA

SEQ ID NO: 25197 - RNA, 1410 nt, Artificial Sequence; identical to SEQ ID NO: 16318
  derived and/or modified CDS sequence (AUadapt) from InfluenzaA__AFN18432__NA

SEQ ID NO: 25198 - RNA, 1410 nt, Artificial Sequence; identical to SEQ ID NO: 16318
  derived and/or modified CDS sequence (AUadapt) from InfluenzaA__AFN18442__NA

SEQ ID NO: 25199 - RNA, 1410 nt, Artificial Sequence; identical to SEQ ID NO: 16318
  derived and/or modified CDS sequence (AUadapt) from InfluenzaA__AFN18452__NA

SEQ ID NO: 25200 - RNA, 1410 nt, Artificial Sequence; identical to SEQ ID NO: 16318
  derived and/or modified CDS sequence (AUadapt) from InfluenzaA__AFN18462__NA

SEQ ID NO: 25201 - RNA, 1410 nt, Artificial Sequence
  derived and/or modified CDS sequence (AUadapt) from InfluenzaA__AFN18472__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaagggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 25202 - RNA, 1410 nt, Artificial Sequence; identical to SEQ ID NO: 16318
  derived and/or modified CDS sequence (AUadapt) from InfluenzaA__AFN18482__NA

SEQ ID NO: 25203 - RNA, 1410 nt, Artificial Sequence; identical to SEQ ID NO: 16318
  derived and/or modified CDS sequence (AUadapt) from InfluenzaA__AFN18492__NA

SEQ ID NO: 25204 - RNA, 1410 nt, Artificial Sequence
  derived and/or modified CDS sequence (AUadapt) from InfluenzaA__AFN18514__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggucgggaacagcucccucugcccggugucgggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagucgguggccugguccgccagcgcgugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgccugcgugaacgggagcugcuucaccgucaugaccgacggcccguccgacggccaggcgagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 25205 - RNA, 1410 nt, Artificial Sequence
  derived and/or modified CDS sequence (AUadapt) from InfluenzaA__AFN18520__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcgugaucaccgacaccaucaagagcuggcgcaacaacauccugcggacgcaggaguccgagugcgcgugcgugaacgggucgugcuucacccucaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 25206 - RNA, 1410 nt, Artificial Sequence; identical to SEQ ID NO: 16318
  derived and/or modified CDS sequence (AUadapt) from InfluenzaA__AFN18522__NA

SEQ ID NO: 25207 - RNA, 1410 nt, Artificial Sequence; identical to SEQ ID NO: 16318
  derived and/or modified CDS sequence (AUadapt) from InfluenzaA__AFN18524__NA

SEQ ID NO: 25208 - RNA, 1410 nt, Artificial Sequence; identical to SEQ ID NO: 24773
  derived and/or modified CDS sequence (AUadapt) from InfluenzaA__AFN18530__NA

SEQ ID NO: 25209 - RNA, 1410 nt, Artificial Sequence; identical to SEQ ID NO: 16318
  derived and/or modified CDS sequence (AUadapt) from InfluenzaA__AFN18532__NA

SEQ ID NO: 25210 - RNA, 1410 nt, Artificial Sequence; identical to SEQ ID NO: 16318
  derived and/or modified CDS sequence (AUadapt) from InfluenzaA__AFN18538__NA

SEQ ID NO: 25211 - RNA, 1410 nt, Artificial Sequence; identical to SEQ ID NO: 16318
  derived and/or modified CDS sequence (AUadapt) from InfluenzaA__AFN18544__NA

SEQ ID NO: 25212 - RNA, 1410 nt, Artificial Sequence; identical to SEQ ID NO: 16318
  derived and/or modified CDS sequence (AUadapt) from InfluenzaA__AFN18546__NA

SEQ ID NO: 25213 - RNA, 1410 nt, Artificial Sequence; identical to SEQ ID NO: 16318
  derived and/or modified CDS sequence (AUadapt) from InfluenzaA__AFN18552__NA

SEQ ID NO: 25214 - RNA, 1410 nt, Artificial Sequence; identical to SEQ ID NO: 16318
  derived and/or modified CDS sequence (AUadapt) from InfluenzaA__AFN18558__NA

SEQ ID NO: 25215 - RNA, 1410 nt, Artificial Sequence; identical to SEQ ID NO: 16318
  derived and/or modified CDS sequence (AUadapt) from InfluenzaA__AFN18560__NA

SEQ ID NO: 25216 - RNA, 1410 nt, Artificial Sequence; identical to SEQ ID NO: 16318
  derived and/or modified CDS sequence (AUadapt) from InfluenzaA__AFN18562__NA

SEQ ID NO: 25217 - RNA, 1410 nt, Artificial Sequence; identical to SEQ ID NO: 16318
  derived and/or modified CDS sequence (AUadapt) from InfluenzaA__AFN18564__NA

SEQ ID NO: 25218 - RNA, 1410 nt, Artificial Sequence; identical to SEQ ID NO: 16318
  derived and/or modified CDS sequence (AUadapt) from InfluenzaA__AFN18566__NA

SEQ ID NO: 25219 - RNA, 1410 nt, Artificial Sequence; identical to SEQ ID NO: 16318
  derived and/or modified CDS sequence (AUadapt) from InfluenzaA__AFN18572__NA

SEQ ID NO: 25220 - RNA, 1410 nt, Artificial Sequence; identical to SEQ ID NO: 16318
  derived and/or modified CDS sequence (AUadapt) from InfluenzaA__AFN18582__NA

SEQ ID NO: 25221 - RNA, 1410 nt, Artificial Sequence; identical to SEQ ID NO: 16318
  derived and/or modified CDS sequence (AUadapt) from InfluenzaA__AFN18592__NA

SEQ ID NO: 25222 - RNA, 1410 nt, Artificial Sequence; identical to SEQ ID NO: 24773
  derived and/or modified CDS sequence (AUadapt) from InfluenzaA__AFN18602__NA

SEQ ID NO: 25223 - RNA, 1410 nt, Artificial Sequence
  derived and/or modified CDS sequence (AUadapt) from InfluenzaA__AFN18612__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucaucaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 25224 - RNA, 1410 nt, Artificial Sequence; identical to SEQ ID NO: 16318
  derived and/or modified CDS sequence (AUadapt) from InfluenzaA__AFN18618__NA

SEQ ID NO: 25225 - RNA, 1410 nt, Artificial Sequence; identical to SEQ ID NO: 19966
  derived and/or modified CDS sequence (AUadapt) from InfluenzaA__AFN18624__NA

SEQ ID NO: 25226 - RNA, 1410 nt, Artificial Sequence
  derived and/or modified CDS sequence (AUadapt) from InfluenzaA__AFN18630__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccugggcugcauccgccccugcuucugggucgagcucauccgggggcgccccaaggagaacaccaucuggaccagcggcuccagcaucuccuucugcggggugaacagcgacaccgucggcugguccuggcccgacggcgccgagcugccguucacgaucgacaaguga

SEQ ID NO: 25227 - RNA, 1410 nt, Artificial Sequence
  derived and/or modified CDS sequence (AUadapt) from InfluenzaA__AFN18636__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccggaucggguacaucugcuccggcaucuucggggacaacccgcgccccaacgacaagaccggcucgugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacucgggguccuucgugcagcacccggagcugacgggccuggacugcauccggcccugcuucugggucgagcucauccgcggccggagcaaggagaacaccaucuggaccuccgggagcuccaucagcuucugcggcgugaacuccgacaccgucggguggagcuggcccgacggcgccgagcugcccuucacgaucgacaaguga

SEQ ID NO: 25228 - RNA, 1410 nt, Artificial Sequence; identical to SEQ ID NO: 16318
  derived and/or modified CDS sequence (AUadapt) from InfluenzaA__AFN18646__NA

SEQ ID NO: 25229 - RNA, 1410 nt, Artificial Sequence; identical to SEQ ID NO: 16318
  derived and/or modified CDS sequence (AUadapt) from InfluenzaA__AFN18656__NA

SEQ ID NO: 25230 - RNA, 1410 nt, Artificial Sequence
  derived and/or modified CDS sequence (AUadapt) from InfluenzaA__AFN18666__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucaucaucgacaaguga

SEQ ID NO: 25231 - RNA, 1410 nt, Artificial Sequence
  derived and/or modified CDS sequence (AUadapt) from InfluenzaA__AFN18676__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccggaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccgagaccgacaacaacuucucgaucaagcaggacaucgugggcaucaacgagugguccggguacagcggcuccuucgugcagcacccggagcugacggggcuggacugcauccggcccugcuucugggucgagcucauccgcggccggcccaaggagaacaccaucuggaccagcggcuccagcaucuccuucugcggggugaacagcgacaccgucggcugguccuggcccgacggggccgagcugccguucacgaucgacaaguga

SEQ ID NO: 25232 - RNA, 1410 nt, Artificial Sequence
  derived and/or modified CDS sequence (AUadapt) from InfluenzaA__AFN18686__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccagcacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucacccucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccuggaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaacggcuucgagaugaucugggaccccaacggguggaccggcaccgacaacaacuucuccaucaagcaggacaucgucgggaucaacgaguggucgggcuacuccgggagcuucgugcagcacccggagcugacgggccucgacugcauccgccccugcuucuggguggagcugauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 25233 - RNA, 1410 nt, Artificial Sequence; identical to SEQ ID NO: 16318
  derived and/or modified CDS sequence (AUadapt) from InfluenzaA__AFN18696__NA

SEQ ID NO: 25234 - RNA, 1410 nt, Artificial Sequence; identical to SEQ ID NO: 21727
  derived and/or modified CDS sequence (AUadapt) from InfluenzaA__AFN18706__NA

SEQ ID NO: 25235 - RNA, 1410 nt, Artificial Sequence; identical to SEQ ID NO: 16318
  derived and/or modified CDS sequence (AUadapt) from InfluenzaA__AFN18716__NA

SEQ ID NO: 25236 - RNA, 1410 nt, Artificial Sequence; identical to SEQ ID NO: 16318
  derived and/or modified CDS sequence (AUadapt) from InfluenzaA__AFN18727__NA

SEQ ID NO: 25237 - RNA, 1410 nt, Artificial Sequence
  derived and/or modified CDS sequence (AUadapt) from InfluenzaA__AFN18737__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagauggugugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 25238 - RNA, 1410 nt, Artificial Sequence; identical to SEQ ID NO: 16318
  derived and/or modified CDS sequence (AUadapt) from InfluenzaA__AFN18743__NA

SEQ ID NO: 25239 - RNA, 1410 nt, Artificial Sequence; identical to SEQ ID NO: 16318
  derived and/or modified CDS sequence (AUadapt) from InfluenzaA__AFN18749__NA

SEQ ID NO: 25240 - RNA, 1410 nt, Artificial Sequence; identical to SEQ ID NO: 16318
  derived and/or modified CDS sequence (AUadapt) from InfluenzaA__AFN18759__NA

SEQ ID NO: 25241 - RNA, 1410 nt, Artificial Sequence
  derived and/or modified CDS sequence (AUadapt) from InfluenzaA__AFN18769__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucacccucaugaccgacggcccguccgacggccaggccagcuacaagaucuuccgcaucgagaaggggaagaucgugaaguccgucgagaugaacgcccccaacuaccacuacgaggagugcucgugcuaccccgacuccaacgagaucacgugcgugugccgggacaacuggcacggcagcaaccgccccuggguguccuucaaccagaaccuggaguaccagaucggguacaucugcagcggcaucuucggggacaacccgcggcccaacgacaagaccggcuccugcggccccgucagcuccaacggggccaacggcgugaagggguucucguucaaguacggcaacgggguguggaucggccgcaccaaguccaucagcagccggaacggcuucgagaugaucugggaccccaacggguggaccggcaccgacaacaacuucuccaucaagcaggacaucgucgggaucaacgaguggagcggcuacuccgggucguucgugcagcacccggagcugacgggccucgacugcauccgccccugcuucuggguggagcugauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 25242 - RNA, 1410 nt, Artificial Sequence; identical to SEQ ID NO: 21042
  derived and/or modified CDS sequence (AUadapt) from InfluenzaA__AFN18775__NA

SEQ ID NO: 25243 - RNA, 1410 nt, Artificial Sequence; identical to SEQ ID NO: 16318
  derived and/or modified CDS sequence (AUadapt) from InfluenzaA__AFN18777__NA

SEQ ID NO: 25244 - RNA, 1410 nt, Artificial Sequence; identical to SEQ ID NO: 16318
  derived and/or modified CDS sequence (AUadapt) from InfluenzaA__AFN18779__NA

SEQ ID NO: 25245 - RNA, 1410 nt, Artificial Sequence
  derived and/or modified CDS sequence (AUadapt) from InfluenzaA__AFN18785__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgauccgccaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 25246 - RNA, 1410 nt, Artificial Sequence
  derived and/or modified CDS sequence (AUadapt) from InfluenzaA__AFN18791__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgaguccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 25247 - RNA, 1410 nt, Artificial Sequence; identical to SEQ ID NO: 16318
  derived and/or modified CDS sequence (AUadapt) from InfluenzaA__AFN18801__NA

SEQ ID NO: 25248 - RNA, 1410 nt, Artificial Sequence; identical to SEQ ID NO: 21559
  derived and/or modified CDS sequence (AUadapt) from InfluenzaA__AFN18811__NA

SEQ ID NO: 25249 - RNA, 1410 nt, Artificial Sequence; identical to SEQ ID NO: 16318
  derived and/or modified CDS sequence (AUadapt) from InfluenzaA__AFN18817__NA

SEQ ID NO: 25250 - RNA, 1410 nt, Artificial Sequence; identical to SEQ ID NO: 16318
  derived and/or modified CDS sequence (AUadapt) from InfluenzaA__AFN18819__NA

SEQ ID NO: 25251 - RNA, 1410 nt, Artificial Sequence; identical to SEQ ID NO: 22132
  derived and/or modified CDS sequence (AUadapt) from InfluenzaA__AFN18821__NA

SEQ ID NO: 25252 - RNA, 1410 nt, Artificial Sequence; identical to SEQ ID NO: 16318
  derived and/or modified CDS sequence (AUadapt) from InfluenzaA__AFN18823__NA

SEQ ID NO: 25253 - RNA, 1410 nt, Artificial Sequence; identical to SEQ ID NO: 16318
  derived and/or modified CDS sequence (AUadapt) from InfluenzaA__AFN18825__NA

SEQ ID NO: 25254 - RNA, 1410 nt, Artificial Sequence; identical to SEQ ID NO: 16318
  derived and/or modified CDS sequence (AUadapt) from InfluenzaA__AFN18827__NA

SEQ ID NO: 25255 - RNA, 1410 nt, Artificial Sequence; identical to SEQ ID NO: 16318
  derived and/or modified CDS sequence (AUadapt) from InfluenzaA__AFN18829__NA

SEQ ID NO: 25256 - RNA, 1410 nt, Artificial Sequence; identical to SEQ ID NO: 16318
  derived and/or modified CDS sequence (AUadapt) from InfluenzaA__AFN18831__NA

SEQ ID NO: 25257 - RNA, 1410 nt, Artificial Sequence; identical to SEQ ID NO: 20277
  derived and/or modified CDS sequence (AUadapt) from InfluenzaA__AFN18833__NA

SEQ ID NO: 25258 - RNA, 1410 nt, Artificial Sequence; identical to SEQ ID NO: 20315
  derived and/or modified CDS sequence (AUadapt) from InfluenzaA__AFN18835__NA

SEQ ID NO: 25259 - RNA, 1410 nt, Artificial Sequence; identical to SEQ ID NO: 16318
  derived and/or modified CDS sequence (AUadapt) from InfluenzaA__AFN18841__NA

SEQ ID NO: 25260 - RNA, 1410 nt, Artificial Sequence
  derived and/or modified CDS sequence (AUadapt) from InfluenzaA__AFN18851__NA
augaaccccaaccagaagaucaucaccaucggcucggugugcaugaccaucgggauggccaaccugauccuccagaucggcaacaugaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 25261 - RNA, 1410 nt, Artificial Sequence; identical to SEQ ID NO: 16318
  derived and/or modified CDS sequence (AUadapt) from InfluenzaA__AFN18857__NA

SEQ ID NO: 25262 - RNA, 1410 nt, Artificial Sequence
  derived and/or modified CDS sequence (AUadapt) from InfluenzaA__AFN18859__NA
augaaccccaaccagaagaucaucaccaucggcucggugugcaugaccaucgggcuggccaaccucauccugcagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcucgccgggaacucgucccugugcccggucagcggcugggccaucuacuccaaggacaacagcauccgcaucggcuccaagggggacguguucgugauccgggagcccuucaucagcugcagcccccuggagugccgcaccuucuuccucacccagggcgcccugcugaacgacaagcacuccaacgggaccaucaaggaccggucccccuaccgcacgcucaugucgugcccgaucggcgagguccccucccccuacaacagccgguucgagagcguggccugguccgcgagcgccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 25263 - RNA, 1410 nt, Artificial Sequence
  derived and/or modified CDS sequence (AUadapt) from InfluenzaA__AFN18861__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcagcgucuccggcugggccaucuacagcaaggacaacuccauccgcaucggcagcaagggggacguguucgugauccgggagccguucaucuccugcagcccccuggagugccgcaccuucuuccugacccagggcgcccuccugaacgacaagcacuccaacgggaccaucaaggaccggucgcccuaccgcacgcugauguccugccccaucggcgaggucccgagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccgugaugaccgacggccccagcgacggccaggccuccuacaagaucuuccgcaucgagaaggggaagaucgucaagagcguggagaugaacgccccgaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccccggccgaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcaccccgagcugacgggccuggacugcauccgcccgugcuucugggucgagcucauccggggccgccccaaggagaacaccaucuggaccuccgggagcuccaucagcuucugcggcgugaacuccgacaccgucggguggagcuggcccgacggcgccgagcugcccuucacgaucgacaaguga

SEQ ID NO: 25264 - RNA, 1410 nt, Artificial Sequence; identical to SEQ ID NO: 16318
  derived and/or modified CDS sequence (AUadapt) from InfluenzaA__AFN18867__NA

SEQ ID NO: 25265 - RNA, 1410 nt, Artificial Sequence; identical to SEQ ID NO: 20954
  derived and/or modified CDS sequence (AUadapt) from InfluenzaA__AFN18877__NA

SEQ ID NO: 25266 - RNA, 1410 nt, Artificial Sequence; identical to SEQ ID NO: 16318
  derived and/or modified CDS sequence (AUadapt) from InfluenzaA__AFN18887__NA

SEQ ID NO: 25267 - RNA, 1410 nt, Artificial Sequence; identical to SEQ ID NO: 20158
  derived and/or modified CDS sequence (AUadapt) from InfluenzaA__AFN18893__NA

SEQ ID NO: 25268 - RNA, 1410 nt, Artificial Sequence
  derived and/or modified CDS sequence (AUadapt) from InfluenzaA__AFN18895__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccggaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccggcccugcuucugggucgagcucaucaagggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 25269 - RNA, 1410 nt, Artificial Sequence; identical to SEQ ID NO: 21042
  derived and/or modified CDS sequence (AUadapt) from InfluenzaA__AFN18905__NA

SEQ ID NO: 25270 - RNA, 1410 nt, Artificial Sequence; identical to SEQ ID NO: 20954
  derived and/or modified CDS sequence (AUadapt) from InfluenzaA__AFN18913__NA

SEQ ID NO: 25271 - RNA, 1410 nt, Artificial Sequence
  derived and/or modified CDS sequence (AUadapt) from InfluenzaA__AFN18919__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggagaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 25272 - RNA, 1410 nt, Artificial Sequence
  derived and/or modified CDS sequence (AUadapt) from InfluenzaA__AFN18929__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucacccucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggcccaacgacaagaccggcucgugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacucgggguccuucgugcagcacccggagcugacgggccucgacugcauccgccccugcuucuggguggagcugauccggggccgccccaaggagaacaccaucuggaccagcggguccagcaucuccuucugcggcgucaacagcgacaccguggggugguccuggagcgacggcgccgagcugcccuucacgaucgacaaguga

SEQ ID NO: 25273 - RNA, 1410 nt, Artificial Sequence; identical to SEQ ID NO: 16318
  derived and/or modified CDS sequence (AUadapt) from InfluenzaA__AFN18939__NA

SEQ ID NO: 25274 - RNA, 1410 nt, Artificial Sequence; identical to SEQ ID NO: 16318
  derived and/or modified CDS sequence (AUadapt) from InfluenzaA__AFN18953__NA

SEQ ID NO: 25275 - RNA, 1410 nt, Artificial Sequence; identical to SEQ ID NO: 16318
  derived and/or modified CDS sequence (AUadapt) from InfluenzaA__AFN18959__NA

SEQ ID NO: 25276 - RNA, 1410 nt, Artificial Sequence; identical to SEQ ID NO: 16318
  derived and/or modified CDS sequence (AUadapt) from InfluenzaA__AFN18965__NA

SEQ ID NO: 25277 - RNA, 1410 nt, Artificial Sequence; identical to SEQ ID NO: 23210
  derived and/or modified CDS sequence (AUadapt) from InfluenzaA__AFN18975__NA

SEQ ID NO: 25278 - RNA, 1410 nt, Artificial Sequence; identical to SEQ ID NO: 16318
  derived and/or modified CDS sequence (AUadapt) from InfluenzaA__AFN18981__NA

SEQ ID NO: 25279 - RNA, 1410 nt, Artificial Sequence
  derived and/or modified CDS sequence (AUadapt) from InfluenzaA__AFN18983__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgccucgaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccccggccgaacgacaagaccggcuccugcggccccgugagcuccaacggggccaacggcgugaagggguucagcuucaaguacggcaacggggucuggaucggccgcaccaagucgaucuccagccggaacggcuucgagaugaucugggaccccaacggguggaccggcaccgacaacaacuucuccaucaagcaggacaucguggggaucaacgaguggagcggcuacuccgggagcuucgugcagcaccccgagcugacgggccuggacugcauccgcccgugcuucugggucgagcucauccggggccgccccaaggagaacaccaucuggaccuccgggagcaucaucuccuucugcggcgugaacagcgacaccgucgggugguccuggcccgacggcgccgagcugcccuucacgaucgacaaguga

SEQ ID NO: 25280 - RNA, 1410 nt, Artificial Sequence; identical to SEQ ID NO: 16318
  derived and/or modified CDS sequence (AUadapt) from InfluenzaA__AFN18985__NA

SEQ ID NO: 25281 - RNA, 1410 nt, Artificial Sequence
  derived and/or modified CDS sequence (AUadapt) from InfluenzaA__AFN18987__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaucgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 25282 - RNA, 1410 nt, Artificial Sequence; identical to SEQ ID NO: 16318
  derived and/or modified CDS sequence (AUadapt) from InfluenzaA__AFN18989__NA

SEQ ID NO: 25283 - RNA, 1410 nt, Artificial Sequence; identical to SEQ ID NO: 16318
  derived and/or modified CDS sequence (AUadapt) from InfluenzaA__AFN18995__NA

SEQ ID NO: 25284 - RNA, 1410 nt, Artificial Sequence; identical to SEQ ID NO: 25262
  derived and/or modified CDS sequence (AUadapt) from InfluenzaA__AFN19001__NA

SEQ ID NO: 25285 - RNA, 1410 nt, Artificial Sequence; identical to SEQ ID NO: 16318
  derived and/or modified CDS sequence (AUadapt) from InfluenzaA__AFN19007__NA

SEQ ID NO: 25286 - RNA, 1410 nt, Artificial Sequence; identical to SEQ ID NO: 16318
  derived and/or modified CDS sequence (AUadapt) from InfluenzaA__AFN19024__NA

SEQ ID NO: 25287 - RNA, 1410 nt, Artificial Sequence
  derived and/or modified CDS sequence (AUadapt) from InfluenzaA__AFN19025__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaagauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 25288 - RNA, 1410 nt, Artificial Sequence; identical to SEQ ID NO: 16318
  derived and/or modified CDS sequence (AUadapt) from InfluenzaA__AFN19027__NA

SEQ ID NO: 25289 - RNA, 1410 nt, Artificial Sequence; identical to SEQ ID NO: 16318
  derived and/or modified CDS sequence (AUadapt) from InfluenzaA__AFN19032__NA

SEQ ID NO: 25290 - RNA, 1410 nt, Artificial Sequence; identical to SEQ ID NO: 16318
  derived and/or modified CDS sequence (AUadapt) from InfluenzaA__AFN19038__NA

SEQ ID NO: 25291 - RNA, 1410 nt, Artificial Sequence; identical to SEQ ID NO: 24773
  derived and/or modified CDS sequence (AUadapt) from InfluenzaA__AFN19049__NA

SEQ ID NO: 25292 - RNA, 1410 nt, Artificial Sequence; identical to SEQ ID NO: 16318
  derived and/or modified CDS sequence (AUadapt) from InfluenzaA__AFN19055__NA

SEQ ID NO: 25293 - RNA, 1410 nt, Artificial Sequence; identical to SEQ ID NO: 16318
  derived and/or modified CDS sequence (AUadapt) from InfluenzaA__AFN19065__NA

SEQ ID NO: 25294 - RNA, 1410 nt, Artificial Sequence; identical to SEQ ID NO: 16318
  derived and/or modified CDS sequence (AUadapt) from InfluenzaA__AFN19071__NA

SEQ ID NO: 25295 - RNA, 1410 nt, Artificial Sequence; identical to SEQ ID NO: 16318
  derived and/or modified CDS sequence (AUadapt) from InfluenzaA__AFN19077__NA

SEQ ID NO: 25296 - RNA, 1410 nt, Artificial Sequence; identical to SEQ ID NO: 16318
  derived and/or modified CDS sequence (AUadapt) from InfluenzaA__AFN19083__NA

SEQ ID NO: 25297 - RNA, 1410 nt, Artificial Sequence; identical to SEQ ID NO: 16318
  derived and/or modified CDS sequence (AUadapt) from InfluenzaA__AFN19089__NA

SEQ ID NO: 25298 - RNA, 1410 nt, Artificial Sequence; identical to SEQ ID NO: 16318
  derived and/or modified CDS sequence (AUadapt) from InfluenzaA__AFN19099__NA

SEQ ID NO: 25299 - RNA, 1410 nt, Artificial Sequence; identical to SEQ ID NO: 16318
  derived and/or modified CDS sequence (AUadapt) from InfluenzaA__AFN19105__NA

SEQ ID NO: 25300 - RNA, 1410 nt, Artificial Sequence; identical to SEQ ID NO: 16318
  derived and/or modified CDS sequence (AUadapt) from InfluenzaA__AFN19114__NA

SEQ ID NO: 25301 - RNA, 1410 nt, Artificial Sequence; identical to SEQ ID NO: 16318
  derived and/or modified CDS sequence (AUadapt) from InfluenzaA__AFN19126__NA

SEQ ID NO: 25302 - RNA, 1410 nt, Artificial Sequence; identical to SEQ ID NO: 16318
  derived and/or modified CDS sequence (AUadapt) from InfluenzaA__AFN19136__NA

SEQ ID NO: 25303 - RNA, 1410 nt, Artificial Sequence; identical to SEQ ID NO: 16318
  derived and/or modified CDS sequence (AUadapt) from InfluenzaA__AFN19146__NA

SEQ ID NO: 25304 - RNA, 1410 nt, Artificial Sequence; identical to SEQ ID NO: 16318
  derived and/or modified CDS sequence (AUadapt) from InfluenzaA__AFN19156__NA

SEQ ID NO: 25305 - RNA, 1410 nt, Artificial Sequence; identical to SEQ ID NO: 16318
  derived and/or modified CDS sequence (AUadapt) from InfluenzaA__AFN19166__NA

SEQ ID NO: 25306 - RNA, 1410 nt, Artificial Sequence; identical to SEQ ID NO: 16318
  derived and/or modified CDS sequence (AUadapt) from InfluenzaA__AFN19186__NA

SEQ ID NO: 25307 - RNA, 1410 nt, Artificial Sequence; identical to SEQ ID NO: 24773
  derived and/or modified CDS sequence (AUadapt) from InfluenzaA__AFN19196__NA

SEQ ID NO: 25308 - RNA, 1410 nt, Artificial Sequence; identical to SEQ ID NO: 16318
  derived and/or modified CDS sequence (AUadapt) from InfluenzaA__AFN19205__NA

SEQ ID NO: 25309 - RNA, 1410 nt, Artificial Sequence; identical to SEQ ID NO: 16318
  derived and/or modified CDS sequence (AUadapt) from InfluenzaA__AFN19215__NA

SEQ ID NO: 25310 - RNA, 1410 nt, Artificial Sequence; identical to SEQ ID NO: 16318
  derived and/or modified CDS sequence (AUadapt) from InfluenzaA__AFN19225__NA

SEQ ID NO: 25311 - RNA, 1410 nt, Artificial Sequence; identical to SEQ ID NO: 16318
  derived and/or modified CDS sequence (AUadapt) from InfluenzaA__AFN19235__NA

SEQ ID NO: 25312 - RNA, 1410 nt, Artificial Sequence; identical to SEQ ID NO: 16318
  derived and/or modified CDS sequence (AUadapt) from InfluenzaA__AFN19245__NA

SEQ ID NO: 25313 - RNA, 1410 nt, Artificial Sequence; identical to SEQ ID NO: 16318
  derived and/or modified CDS sequence (AUadapt) from InfluenzaA__AFN19251__NA

SEQ ID NO: 25314 - RNA, 1410 nt, Artificial Sequence; identical to SEQ ID NO: 16318
  derived and/or modified CDS sequence (AUadapt) from InfluenzaA__AFN19261__NA

SEQ ID NO: 25315 - RNA, 1410 nt, Artificial Sequence; identical to SEQ ID NO: 24773
  derived and/or modified CDS sequence (AUadapt) from InfluenzaA__AFN19271__NA

SEQ ID NO: 25316 - RNA, 1410 nt, Artificial Sequence; identical to SEQ ID NO: 20871
  derived and/or modified CDS sequence (AUadapt) from InfluenzaA__AFN19281__NA

SEQ ID NO: 25317 - RNA, 1410 nt, Artificial Sequence
  derived and/or modified CDS sequence (AUadapt) from InfluenzaA__AFN19287__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccuguccgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 25318 - RNA, 1410 nt, Artificial Sequence; identical to SEQ ID NO: 16318
  derived and/or modified CDS sequence (AUadapt) from InfluenzaA__AFN19297__NA

SEQ ID NO: 25319 - RNA, 1410 nt, Artificial Sequence; identical to SEQ ID NO: 16318
  derived and/or modified CDS sequence (AUadapt) from InfluenzaA__AFN19307__NA

SEQ ID NO: 25320 - RNA, 1410 nt, Artificial Sequence; identical to SEQ ID NO: 16318
  derived and/or modified CDS sequence (AUadapt) from InfluenzaA__AFN19317__NA

SEQ ID NO: 25321 - RNA, 1410 nt, Artificial Sequence; identical to SEQ ID NO: 24773
  derived and/or modified CDS sequence (AUadapt) from InfluenzaA__AFN19327__NA

SEQ ID NO: 25322 - RNA, 1410 nt, Artificial Sequence; identical to SEQ ID NO: 16318
  derived and/or modified CDS sequence (AUadapt) from InfluenzaA__AFN19346__NA

SEQ ID NO: 25323 - RNA, 1410 nt, Artificial Sequence
  derived and/or modified CDS sequence (AUadapt) from InfluenzaA__AFN19352__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaugaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacacgccccggaagaacgacuccucguccagcgggcacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggucgaacccgaaguccaagcugcagaucaaccgccaggugaucguggaccggagcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcccaucuga

SEQ ID NO: 25324 - RNA, 1410 nt, Artificial Sequence
  derived and/or modified CDS sequence (AUadapt) from InfluenzaA__AFN19354__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcgggcacggggucaagggcugggccuucgacgacgggaacgacguguggaugggccgcaccaucaacgagacgucgcggcucggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcccaucuga

SEQ ID NO: 25325 - RNA, 1410 nt, Artificial Sequence; identical to SEQ ID NO: 25324
  derived and/or modified CDS sequence (AUadapt) from InfluenzaA__AFN19356__NA

SEQ ID NO: 25326 - RNA, 1410 nt, Artificial Sequence; identical to SEQ ID NO: 25324
  derived and/or modified CDS sequence (AUadapt) from InfluenzaA__AFN19358__NA

SEQ ID NO: 25327 - RNA, 1410 nt, Artificial Sequence; identical to SEQ ID NO: 25324
  derived and/or modified CDS sequence (AUadapt) from InfluenzaA__AFN19360__NA

SEQ ID NO: 25328 - RNA, 1410 nt, Artificial Sequence
  derived and/or modified CDS sequence (AUadapt) from InfluenzaA__AFN19362__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccucguccugccacgacgggaaggccuggcugcacgugugcaucaccggcgacgacaagaacgcgaccgccagcuucaucuacaacgggcggcucguggacuccguggucucgugguccaaggagauccugcgcacccaggagagcgagugcgugugcaucaacggcacgugcaccguggucaugaccgacggguccgccucgggcaaggccgacaccaagauccuguucaucgaggagggcaagaucgugcacacgagcacccucuccgggucggcgcagcacguggaggagugcuccugcuacccccgguacccgggcguccgcugcgugugccgggacaacuggaaggggucgaaccgccccaucguggacaucaacaucaaggaccacuccaucgucagcuccuacgugugcucgggccuggugggcgacaccccgcggaagaacgacuccagcuccucgucccacugccuggaccccaacaacgaggagggcgggcacggggucaagggcugggccuucgacgacgggaacgacguguggaugggccgcaccaucaacgagacgucgcggcucggcuacgagaccuucaaggucaucgaggggugguccaaccccaagagcaagcugcagaucaaccgccaggugaucguggaccggggcgaccgcuccggguacucgggcaucuucuccgucgaggggaagcggugcaucaaccgcugcuucuacguggagcugauccggggccgcaaggaggagaccgaggugcucuggaccagcaacucgaucgucguguucugcggcacguccgggaccuacggcaccgggagcuggcccgacggcgccgaccugaaccugaugcccaucuga

SEQ ID NO: 25329 - RNA, 1410 nt, Artificial Sequence; identical to SEQ ID NO: 25324
  derived and/or modified CDS sequence (AUadapt) from InfluenzaA__AFN19364__NA

SEQ ID NO: 25330 - RNA, 1410 nt, Artificial Sequence; identical to SEQ ID NO: 21920
  derived and/or modified CDS sequence (AUadapt) from InfluenzaA__AFN19366__NA

SEQ ID NO: 25331 - RNA, 1410 nt, Artificial Sequence; identical to SEQ ID NO: 25324
  derived and/or modified CDS sequence (AUadapt) from InfluenzaA__AFN19370__NA

SEQ ID NO: 25332 - RNA, 1410 nt, Artificial Sequence
  derived and/or modified CDS sequence (AUadapt) from InfluenzaA__AFN19374__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucaaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaccgacuccucguccagcucccacugccuggaccccaacaacgaggagggcgggcacggcgucaaggggugggccuucgacgacggcaacgacguguggaugggccgcacgaucaacgagaccucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggacgucgaacuccaucgucguguucugcgggaccagcggcaccuacgggaccggcuccuggcccgacggggccgaccugaaccugaugcccaucuga

SEQ ID NO: 25333 - RNA, 1410 nt, Artificial Sequence; identical to SEQ ID NO: 25324
  derived and/or modified CDS sequence (AUadapt) from InfluenzaA__AFN19376__NA

SEQ ID NO: 25334 - RNA, 1410 nt, Artificial Sequence; identical to SEQ ID NO: 25324
  derived and/or modified CDS sequence (AUadapt) from InfluenzaA__AFN19378__NA

SEQ ID NO: 25335 - RNA, 1410 nt, Artificial Sequence
  derived and/or modified CDS sequence (AUadapt) from InfluenzaA__AFN19380__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccgagcgaguaccggaacugguccaagccccagugcgacaucaccggguucgcccccuucucgaaggacaacuccauccgccugagcgcgggcggggacaucugggucacccgggagcccuacguguccugcgacccggacaagugcuaccaguucgcccugggccaggggaccacgcucaacaacgugcacucgaacaacaccguccgcgaccggacccccuaccgcacccugcugaugaacgagcucggcgugcccuuccaccugggcacgaagcaggucugcaucgccugguccagcuccucgugccacgacgggaaggccuggcugcacgugugcaucaccggcgacgacaagaacgccaccgcguccuucaucuacaacgggcggcucguggacagcguggucuccuggucgaaggagauccugcgcacccaggaguccgagugcgugugcaucaacggcacgugcaccguggucaugaccgacgggagcgccucgggcaaggccgacaccaagauccuguucaucgaggagggcaagaucgugcacacguccacccucagcggguccgcccagcacguggaggagugcucgugcuacccccgguacccgggcguccgcugcgugugccgggacaacuggaagggguccaaccgccccaucguggacaucaacaucaaggaccacagcaucgucuccucguacgugugcuccggccuggugggcgacacgccccggaagaacgacagcuccucguccagccacugccuggaccccaacaacgaggagggcgggcacggggucaagggcugggcguucgacgacgggaacgacguguggaugggccgcaccaucaacgagaccucccggcucggcuacgagaccuucaaggucaucgagggguggucgaacccgaaguccaagcugcagaucaaccgccaggugaucguggaccggggcgaccgcagcggguacuccggcaucuucucggucgagggcaagagcugcaucaaccggugcuucuacguggagcugauccgcgggcggaaggaggagaccgaggugcucuggaccuccaacucgaucgucguguucugcggcacguccgggaccuacggcaccgggagcuggcccgacggcgccgaccugaaccugaugcccaucuga

SEQ ID NO: 25336 - RNA, 1410 nt, Artificial Sequence; identical to SEQ ID NO: 25332
  derived and/or modified CDS sequence (AUadapt) from InfluenzaA__AFN19382__NA

SEQ ID NO: 25337 - RNA, 1410 nt, Artificial Sequence; identical to SEQ ID NO: 25324
  derived and/or modified CDS sequence (AUadapt) from InfluenzaA__AFN19384__NA

SEQ ID NO: 25338 - RNA, 1410 nt, Artificial Sequence
  derived and/or modified CDS sequence (AUadapt) from InfluenzaA__AFN19386__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcgggcacggggucaagggcugggccuucgacgacgggaacgacguguggaugggccgcaccaucaacgagacgucgcggcucggcuacgagaccuucaaggucaucgaggggugguccaaccccaagagcaagcugcagaucaaccgccagaucaucguggaccggggcgaccgcuccggguacucgggcaucuucuccguggagggcaagagcugcaucaaccggugcuucuacgucgagcugauccgcgggcggaaggaggagaccgaggugcucuggaccucgaacuccaucguggucuucugcggcacgagcgggaccuacggcaccggguccuggcccgacggcgccgaccugaaccugaugcccaucuga

SEQ ID NO: 25339 - RNA, 1410 nt, Artificial Sequence; identical to SEQ ID NO: 25324
  derived and/or modified CDS sequence (AUadapt) from InfluenzaA__AFN19388__NA

SEQ ID NO: 25340 - RNA, 1410 nt, Artificial Sequence; identical to SEQ ID NO: 25324
  derived and/or modified CDS sequence (AUadapt) from InfluenzaA__AFN19390__NA

SEQ ID NO: 25341 - RNA, 1410 nt, Artificial Sequence
  derived and/or modified CDS sequence (AUadapt) from InfluenzaA__AFN19392__NA
augaaccccaaccagaagaucaucaccaucggcucggugucccugaccaucucgacgaucugcuucuucaugcagaucgccguccucaucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggugacccgggagcccuacgugagcugcgacccggacaagugcuaccaguucgcccugggccaggggaccacgcucaacaacguccacuccaacaacaccgugcgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccgucgugagcugguccaaggagauccugcgcacccaggagucggagugcgugugcaucaacggcacgugcaccgucgugaugaccgacggguccgccagcggcaaggccgacaccaagauccuguucaucgaggagggcaagaucgugcacacgucgacccucuccgggucggcgcagcacgucgaggagugcuccugcuacccccgguacccgggcgugcgcugcgugugccgggacaacuggaaggggagcaaccgccccaucgucgacaucaacaucaaggaccacuccaucgugucguccuacgugugcagcggccuggucggcgacaccccgcggaagaacgacuccucguccagcucccacugccuggaccccaacaacgaggagggcgggcacggggugaagggcugggccuucgacgacgggaacgacgucuggaugggccgcaccaucaacgagacgucgcggcucggcuacgagaccuucaaggugaucgaggggugguccaaccccaagagcaagcugcagaucaaccgccaggugaucgucgaccggggcgaccgcuccggguacucgggcaucuucuccguggagggcaagagcugcaucaaccggugcuucuacguggagcugauccgcgggcggaaggaggagaccgagguccucuggaccucgaacuccaucgugguguucugcggcacgagcgggaccuacggcaccggguccuggcccgacggcgccgaccugaaccugaugcccaucuga

SEQ ID NO: 25342 - RNA, 1410 nt, Artificial Sequence; identical to SEQ ID NO: 24189
  derived and/or modified CDS sequence (AUadapt) from InfluenzaA__AFN19394__NA

SEQ ID NO: 25343 - RNA, 1410 nt, Artificial Sequence
  derived and/or modified CDS sequence (AUadapt) from InfluenzaA__AFN19396__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggacauccugcgcacccaggagucggagugcgugugcaucaacggcacgugcgccguggucaugaccgacggguccgccagcggcaaggcggacaccaagauccucuucaucgaggagggcaagaucgugcacaccucgacgcuguccgggucggcccagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggaccggggcaaccgcuccggguacucgggcaucuucuccgucgaggggaagaacugcaucaaccggugcuucuacguggagcucauccgcggccggaaggaggagaccgaggugcuguggaccagcaacucgaucgucguguucugcggcaccuccgggacguacggcaccgggagcuggccggacggcgccgaccugaaccucaugcccaucuga

SEQ ID NO: 25344 - RNA, 1410 nt, Artificial Sequence
  derived and/or modified CDS sequence (AUadapt) from InfluenzaA__AFN19398__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggucggcgcagcacguggaggagugcuccugcuacccccgguacccgggcguccgcugcgugugccgggacaacuggcgcgggagcaaccggcccaucguggacaucaacaucaaggaccacuccaucgucucguccuacgugugcagcggccuggugggcgacaccccgcgcaagaacgacuccucguccagcucccacugccuggaccccaacaacgaggagggcgggcacggggucaagggcugggccuucgacgacgggaacgacguguggaugggccggaccaucaacgagacgucgcgccucggcuacgagaccuucaaggucaucgaggggugguccaaccccaagagcaagcugcagaucaaccgccaggugaucguggaccggggcgaccgguccggguacucgggcaucuucuccgucgagggcaagagcugcaucaaccgcugcuucuacguggagcugauccgggggcgcaaggaggagaccgaggugcucuggaccucgaacuccaucgucguguucugcggcacgagcgggaccuacggcaccggguccuggcccgacggcgccgaccugaaccugaugcccaucuga

SEQ ID NO: 25345 - RNA, 1410 nt, Artificial Sequence
  derived and/or modified CDS sequence (AUadapt) from InfluenzaA__AFN19400__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccgagcgaguaccggaacugguccaagccccagugcgacaucaccggguucgcccccuucucgaaggacaacuccauccgccugagcgacggcggggacaucugggucacccgggagcccuacguguccugcgacccggacaagugcuaccaguucgcgcugggccaggggaccacgcucaacaacgugcacucgaacaacaccguccgcgaccggacccccuaccgcacccugcugaugaacgagcucggcgugcccuuccaccugggcacgaagcaggucugcaucgccugguccagcuccucgugccacgacgggaaggccuggcugcacgugugcaucaccggcgacgacaagaacgccaccgccuccuucaucuacaacgggcggcucguggacagcguggucuccuggucgaaggagauccugcgcacccaggaguccgagugcgugugcaucaacggcacgugcaccguggucaugaccgacgggagcgcgucgggcaaggccgacaccaagauccuguucaucgaggagggcaagaucgugcacacguccacccucagcggguccgcccagcacguggaggagugcucgugcuacccccgguacccgggcguccgcugcgugugccgggacaacuggaagggguccaaccgccccaucguggacaucaacaucaaggaccacagcaucgucuccucguacgugugcuccggccuggugggcgacacgccccggaagaacgacagcuccucguccagccacugccuggaccccaacaacgaggagggcgggcacggggucaagggcugggccuucgacgacgggaacgacguguggaugggccgcaccaucaacgagaccucccggcucggcuacgagaccuucaaggucaucgagggguggucgaacccgaaguccaagcugcagaucaaccgccaggugaucguggaccggggcgaccgcagcggguacuccggcaucuucucggucgagggcaagagcugcaucaaccggugcuucuacguggagcugauccgcgggcggaaggaggagaccgaggugcucuggaccuccaacucgaucgucguguucugcggcacguccgggaccuacggcaccgggagcuggcccgacggcgcggaccugaaccugaugcccaucuga

SEQ ID NO: 25346 - RNA, 1410 nt, Artificial Sequence; identical to SEQ ID NO: 25324
  derived and/or modified CDS sequence (AUadapt) from InfluenzaA__AFN19402__NA

SEQ ID NO: 25347 - RNA, 1410 nt, Artificial Sequence; identical to SEQ ID NO: 25324
  derived and/or modified CDS sequence (AUadapt) from InfluenzaA__AFN19404__NA

SEQ ID NO: 25348 - RNA, 1410 nt, Artificial Sequence; identical to SEQ ID NO: 25324
  derived and/or modified CDS sequence (AUadapt) from InfluenzaA__AFN19406__NA

SEQ ID NO: 25349 - RNA, 1410 nt, Artificial Sequence; identical to SEQ ID NO: 25324
  derived and/or modified CDS sequence (AUadapt) from InfluenzaA__AFN19410__NA

SEQ ID NO: 25350 - RNA, 1410 nt, Artificial Sequence; identical to SEQ ID NO: 25324
  derived and/or modified CDS sequence (AUadapt) from InfluenzaA__AFN19412__NA

SEQ ID NO: 25351 - RNA, 1410 nt, Artificial Sequence; identical to SEQ ID NO: 25324
  derived and/or modified CDS sequence (AUadapt) from InfluenzaA__AFN19414__NA

SEQ ID NO: 25352 - RNA, 1410 nt, Artificial Sequence; identical to SEQ ID NO: 25324
  derived and/or modified CDS sequence (AUadapt) from InfluenzaA__AFN19416__NA

SEQ ID NO: 25353 - RNA, 1410 nt, Artificial Sequence
  derived and/or modified CDS sequence (AUadapt) from InfluenzaA__AFN19418__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggccgggccgacaccaagauccuguucaucgaggagggcaagaucgugcacacgucgacccucuccgggucggcgcagcacguggaggagugcuccugcuacccccgcuacccgggcguccggugcgugugccgcgacaacuggaaggggagcaaccggcccaucguggacaucaacaucaaggaccacuccaucgucucguccuacgugugcagcggccuggugggcgacaccccgcgcaagaacgacuccucguccagcucccacugccuggaccccaacaacgaggagggcgggcacggggucaagggcugggccuucgacgacgggaacgacguguggaugggccggaccaucaacgagacgucgcgccucggcuacgagaccuucaaggucaucgaggggugguccaaccccaagagcaagcugcagaucaaccgccaggugaucguggaccggggcgaccgguccggguacucgggcaucuucuccgucgagggcaagagcugcaucaaccgcugcuucuacguggagcugauccgggggcgcaaggaggagaccgaggugcucuggaccucgaacuccaucgucguguucugcggcacgagcgggaccuacggcaccggguccuggcccgacggcgccgaccugaaccugaugcccaucuga

SEQ ID NO: 25354 - RNA, 1410 nt, Artificial Sequence
  derived and/or modified CDS sequence (AUadapt) from InfluenzaA__AFN19420__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaugaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcgggcacggggucaagggcugggccuucgacgacgggaacgacguguggaugggccgcaccaucaacgagacgucgcggcucggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcccaucuga

SEQ ID NO: 25355 - RNA, 1410 nt, Artificial Sequence
  derived and/or modified CDS sequence (AUadapt) from InfluenzaA__AFN19422__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccgggaacgacaagaacgcgaccgccucguucaucuacaacggccggcucguggacuccguggucagcugguccaaggaggugcugcgcacccaggagucggagugcgugugcaucaacgggacgugcaccgucgugaugaccgacggcuccgccagcggcaaggccgacaccaagauccuguucaucgaggaggggaagaucgugcacacgucgacccucuccggcucggcgcagcacgucgaggagugcuccugcuacccccgguacccgggggugcgcugcgugugccgggacaacuggaagggcagcaaccgccccaucgucgacaucaacaucaaggaccacuccaucgugucguccuacgugugcagcggccuggucggggacaccccgcggaagaacgacuccucguccagcucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggugaucgucgaccgcggggaccgguccggcuacucggggaucuucuccguggagggcaagagcugcaucaaccggugcuucuacguggagcugauccgcggccggaaggaggagaccgagguccucuggaccucgaacuccaucgugguguucugcgggacgagcggcaccuacgggaccggcuccuggcccgacggggccgaccugaaccugaugcccaucuga

SEQ ID NO: 25356 - RNA, 1410 nt, Artificial Sequence
  derived and/or modified CDS sequence (AUadapt) from InfluenzaA__AFN19426__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacgagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcgggcacggggucaagggcugggccuucgacgacgggaacgacguguggaugggccgcaccaucaacgagacgucgcggcucggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcccaucuga

SEQ ID NO: 25357 - RNA, 1410 nt, Artificial Sequence; identical to SEQ ID NO: 25324
  derived and/or modified CDS sequence (AUadapt) from InfluenzaA__AFN19428__NA

SEQ ID NO: 25358 - RNA, 1410 nt, Artificial Sequence
  derived and/or modified CDS sequence (AUadapt) from InfluenzaA__AFN19430__NA
augaaccccaaccagaagaucaucaccaucggcucggugucccugaccaucagcacgaucugcuucuucaugcagaucgccauccucaucaucaccgucacccugcacuucaagcaguacgaguucaacuccccgcccaacaaccaggugaugcugugcgagcccaccaucaucgagcgcaacaugacggagaucguguaccucaccaacaccaccaucgagaaggagaucugccccaagccggccgaguaccggaacuggucgaagccccagugcgacaucacgggguucgcgcccuucuccaaggacaacagcauccgccuguccgccggcggggacaucugggucacccgggagcccuacgugucgugcgacccggacaagugcuaccaguucgcccugggccaggggaccacccucaacaacgugcacuccaacaacacgguccgcgaccggacccccuaccgcacccugcugaugaacgagcucggcgugcccuuccaccugggcaccaagcaggucugcaucgccuggagcuccucguccugccacgacgggaaggccuggcugcacgugugcaucacgggcgacgacaagaacgcgaccgccagcuucaucuacaacgggcggcucguggacuccguggucucgugguccaaggagauccugcgcacccaggagagcgagugcgugugcaucaacgggaccugcacgguggucaugaccgacggguccgccucgggcaaggccgacaccaagauccuguucaucgaggagggcaagaucgugcacaccagcacgcucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcggccacggggucaagggcugggccuucgacgacgggaacgacguguggaugggccgcaccaucaacgagaccucgcggcucggcuacgagacguucaaggucaucgaggggugguccaaccccaagagcaagcugcagaucaaccgccaggugaucguggaccgguccgaccgcucgggcuacuccgggaucuucagcgucgagggcaagucgugcaucaaccggugcuucuacguggagcugauccgcgggcggaaggaggagaccgaggugcucuggaccuccaacagcaucgucguguucugcggcaccuccggcacguacgggaccggcagcuggcccgacggggccgaccugaaccugaugcccaucuga

SEQ ID NO: 25359 - RNA, 1410 nt, Artificial Sequence
  derived and/or modified CDS sequence (AUadapt) from InfluenzaA__AFN19432__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggaccccgcaccgcacccugcugaugaacgagcucggcgugcccuuccaccugggcacgaagcaggucugcaucgccuggucguccucguccugccacgacgggaaggccuggcugcacgugugcaucaccggcgacgacaagaacgcgaccgccagcuucaucuacaacgggcggcucguggacuccguggucucgugguccaaggagauccugcgcacccaggagagcgagugcgugugcaucaacggcacgugcaccguggucaugaccgacggguccgccucgggcaaggccgacaccaagauccuguucaucgaggagggcaagaucgugcacacgagcacccucuccgggucggcgcagcacguggaggagugcuccugcuacccccgguacccgggcguccgcugcgugugccgggacaacuggaaggggucgaaccgccccaucguggacaucaacaucaaggaccacuccaucgucagcuccuacgugugcucgggccuggugggcgacacgccccggaagaacgacuccagcuccucgucccacugccuggaccccaacaacgaggagggcgggcacggggucaagggcugggccuucgacgacgggaacgacguguggaugggccgcaccaucaacgagaccucgcggcucggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcccaucuga

SEQ ID NO: 25360 - RNA, 1410 nt, Artificial Sequence
  derived and/or modified CDS sequence (AUadapt) from InfluenzaA__AFN19434__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaugaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggagcgcgcagcacguggaggagugcuccugcuacccccgguacccgggcguccgcugcgugugccgggacaacuggaaggggucgaaccgccccaucguggacaucaacaucaaggaccacuccaucgucagcuccuacgugugcucgggccuggugggcgacaccccgcggaagaacgacuccagcuccucgucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagucgaagcugcagaucaaccgccaggugaucguggaccgguccgaccgcagcggcuacuccgggaucuucucggucgagggcaagagcugcaucaaccggugcuucuacguggagcugauccgcgggcggaaggaggagaccgaggugcucuggaccuccaacucgaucgucguguucugcggcacguccggcaccuacgggaccggcagcuggcccgacggggccgaccugaaccugaugcccaucuga

SEQ ID NO: 25361 - RNA, 1410 nt, Artificial Sequence; identical to SEQ ID NO: 16339
  derived and/or modified CDS sequence (AUadapt) from InfluenzaA__AFN19436__NA

SEQ ID NO: 25362 - RNA, 1410 nt, Artificial Sequence
  derived and/or modified CDS sequence (AUadapt) from InfluenzaA__AFN19438__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaugaccgagaucguguaccucaccaacaccacgaucgagaaggagaucugccccaagccggccgaguaccggaacuggucgaagccccagugcgacaucaccggguucgcgcccuucuccaaggacaacagcauccgccuguccgccggcggggacaucugggucacccgggagcccuacgugucgugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccucguccugccacgacgggaaggccuggcugcacgugugcaucaccggcgacgacaagaacgcgaccgccagcuucaucuacaacgggcggcucguggacuccguggucucgugguccaaggagauccugcgcacccaggagagcgagugcgugugcaucaacggcacgugcaccguggucaugaccgacggguccgccucgggcaaggccgacaccaagauccuguucaucgaggagggcaagaucgugcacacgagcacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcgggcacggggucaagggcugggccuucgacgacgggaacgacguguggaugggccgcaccaucaacgagacgucgcggcucggcuacgagaccuucaaggucaucgaggggugguccaaccccaagagcaagcugcagaucaaccgccaggugaucguggaccgguccgaccgcucgggcuacuccgggaucuucagcgucgagggcaagucgugcaucaaccggugcuucuacguggagcugauccgcgggcggaaggaggagaccgaggugcucuggaccuccaacagcaucgucguguucugcggcacguccggcaccuacgggaccggcagcuggcccgacggggccgaccugaaccugauguccaucuga

SEQ ID NO: 25363 - RNA, 1410 nt, Artificial Sequence
  derived and/or modified CDS sequence (AUadapt) from InfluenzaA__AFN19442__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccaucaucgagaaggagaucugccccaagccgacggaguaccggaacuggucgaagccccagugcgacaucaccggguucgcccccuucuccaaggacaacagcauccgccuguccgcgggcggggacaucugggucacccgggagcccuacgugucgugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccucguccugccacgacgggaaggccuggcugcacgugugcaucaccggcgacgacaagaacgccaccgcgagcuucaucuacaacgggcggcucguggacuccguggucucgugguccaaggagauccugcgcacccaggagagcgagugcgugugcaucaacggcacgugcaccguggucaugaccgacggguccgccucgggcaaggccgacaccaagauccuguucaucgaggagggcaagaucgugcacacgagcacccucuccgggucggcccagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcgggcacggggucaagggcugggcguucgacgacgggaacgacguguggaugggccgcaccaucaacgagacgucgcggcucggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcacaucuga

SEQ ID NO: 25364 - RNA, 1410 nt, Artificial Sequence; identical to SEQ ID NO: 16339
  derived and/or modified CDS sequence (AUadapt) from InfluenzaA__AFN19446__NA

SEQ ID NO: 25365 - RNA, 1410 nt, Artificial Sequence; identical to SEQ ID NO: 16339
  derived and/or modified CDS sequence (AUadapt) from InfluenzaA__AFN19448__NA

SEQ ID NO: 25366 - RNA, 1410 nt, Artificial Sequence; identical to SEQ ID NO: 25324
  derived and/or modified CDS sequence (AUadapt) from InfluenzaA__AFN19458__NA

SEQ ID NO: 25367 - RNA, 1410 nt, Artificial Sequence
  derived and/or modified CDS sequence (AUadapt) from InfluenzaA__AFN19460__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacaugcacuccaacaacaccgugcgcgaccggacccccuaccgcacccugcugaugaacgagcucggcguccccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggugagcugguccaacgagauccugcgcacccaggagucggagugcgucugcaucaacgggacgugcaccguggugaugaccgacggcuccgccagcggcaaggccgacaccaagauccuguucaucgaggaggggaagaucguccacacgucgacccucuccggcucggcgcagcacguggaggagugcuccugcuacccccgguacccgggggugcgcugcgucugccgggacaacuggaagggcagcaaccgccccaucguggacaucaacaucaaggaccacuccaucgugucguccuacgucugcagcggccuggugggggacaccccgcggaagaacgacuccucguccagcucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggucaucguggaccgcggggaccgguccggcuacucggggaucuucuccguggagggcaagagcugcaucaaccggugcuucuacgucgagcugauccgcggccggaaggaggagaacgaggugcucuggaccucgaacuccaucguggucuucugcgggaccagcggcacguacgggaccggcuccuggcccgacggggccgaccugaaccugaugcccaucuga

SEQ ID NO: 25368 - RNA, 1410 nt, Artificial Sequence; identical to SEQ ID NO: 16339
  derived and/or modified CDS sequence (AUadapt) from InfluenzaA__AFN19462__NA

SEQ ID NO: 25369 - RNA, 1410 nt, Artificial Sequence
  derived and/or modified CDS sequence (AUadapt) from InfluenzaA__AFN19466__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucgcgggguucgcccccuucuccaaggacaacucgauccgccuguccgccggcggggacaucugggucacccgggagcccuacgugagcugcgacccggacaagugcuaccaguucgcccugggccaggggaccacccucaacaacgugcacuccaacaacacgguccgcgaccggacccccuaccgcacccugcugaugaacgagcucggcgugcccuuccaccugggcaccaagcaggucugcaucgccuggucguccagcuccugccacgacgggaaggcguggcugcacgugugcaucacgggcgacgacaagaacgccaccgccucguucaucuacaacgggcggcucguggacuccguggucagcugguccaaggagauccugcgcacccaggagucggagugcgugugcaucaacgggaccugcacgguggucaugaccgacggguccgccagcggcaaggcggacaccaagauccuguucaucgaggagggcaagaucgugcacaccucgacgcucuccgggucggcccagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcggccacggggucaagggcugggccuucgacgacgggaacgacguguggaugggccgcaccaucaacgagaccucgcggcucggcuacgagacguucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcaccagcgggacguacggcaccggguccuggcccgacggcgccgaccugaaccugaugcccaucuga

SEQ ID NO: 25370 - RNA, 1410 nt, Artificial Sequence; identical to SEQ ID NO: 16339
  derived and/or modified CDS sequence (AUadapt) from InfluenzaA__AFN19468__NA

SEQ ID NO: 25371 - RNA, 1410 nt, Artificial Sequence
  derived and/or modified CDS sequence (AUadapt) from InfluenzaA__AFN19470__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaugaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggagcgcgcagcacguggaggagugcuccugcuacccccgguacccgggcguccgcugcgugugccgggacaacuggaaggggucgaaccgccccaucguggacaucaacaucaaggaccacuccaucgucagcuccuacgugugcucgggccuggugggcgacaccccgcggaagaacgacuccagcuccucgucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagucgaagcugcagaucaaccgccaggugaucgugaacaaguccgaccggagcggcuacuccgggaucuucucggucgagggcaagagcugcaucaaccgcugcuucuacguggagcugauccgggggcgcaaggaggagaccgaggugcucuggaccuccaacucgaucgucguguucugcggcacguccggcaccuacgggaccggcagcuggcccgacggggccgaccugaaccugaugcccaucuga

SEQ ID NO: 25372 - RNA, 1410 nt, Artificial Sequence; identical to SEQ ID NO: 25324
  derived and/or modified CDS sequence (AUadapt) from InfluenzaA__AFN19472__NA

SEQ ID NO: 25373 - RNA, 1410 nt, Artificial Sequence
  derived and/or modified CDS sequence (AUadapt) from InfluenzaA__AFN19476__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgccccuguccaaggacaacucgauccgccuguccgccgggggcgacaucugggucacccgggagcccuacgugagcugcgacccggacaagugcuaccaguucgcccucgggcagggcaccacgcugaacaacgugcacuccaacaacaccguccgcgaccggacccccuaccgcacccugcucaugaacgagcugggcgugcccuuccaccuggggacgaagcaggucugcaucgccuggucguccucguccugccacgacggcaaggccuggcuccacgugugcaucaccggggacgacaagaacgcgaccgccagcuucaucuacaacggccggcugguggacuccguggucucgugguccaaggagauccugcgcacccaggagagcgagugcgugugcaucaacgggacgugcaccguggucaugaccgacggcuccgccucgggcaaggccgacaccaagauccucuucaucgaggaggggaagaucgugcacacgagcacccuguccggcucggcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacaccccgcggaagaacgacuccagcuccucgucccacugccucgaccccaacaacgaggagggcgggcacggcgucaaggggugggccuucgacgacggcaacgacguguggaugggccgcaccaucaacgagacgucgcggcugggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcucauccgcggccggaaggaggagaccgaggugcuguggaccucgaacuccaucgucguguucugcgggacgagcggcaccuacgggaccggcuccuggcccgacggggccgaccugaaccucaugcccaucuga

SEQ ID NO: 25374 - RNA, 1410 nt, Artificial Sequence; identical to SEQ ID NO: 25324
  derived and/or modified CDS sequence (AUadapt) from InfluenzaA__AFN19478__NA

SEQ ID NO: 25375 - RNA, 1410 nt, Artificial Sequence
  derived and/or modified CDS sequence (AUadapt) from InfluenzaA__AFN19480__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaugaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccgucggcgaccgcacccccuaccggacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccgccucguggacuccguggucagcugguccaaggagauccugcggacccaggagucggagugcgugugcaucaacgggacgugcaccguggucaugaccgacggcuccgccagcggcaaggccgacaccaagauccuguucaucgaggaggggaagaucgugcacacgucgacccucuccggcagcgcgcagcacguggaggagugcuccugcuacccccgcuacccggggguccggugcgugugccgcgacaacuggaagggcucgaaccggcccaucguggacaucaacaucaaggaccacuccaucgucagcuccuacgugugcucgggccuggugggggacaccccgcgcaagaacgacuccagcuccucgucccacugccuggaccccaacaacgaggagggcgggcacggcgucaaggggugggccuucgacgacggcaacgacguguggaugggccggaccaucaacgagacgagccgccucggguacgagaccuucaaggucaucgagggcugguccaaccccaagucgaagcugcagaucaaccgccaggugaucguggaccgguccgaccggagcggguacuccggcaucuucucggucgagggcaagagcugcaucaaccgcugcuucuacguggagcugauccgggggcgcaaggaggagaccgaggugcucuggaccuccaacucgaucgucguguucugcggcacguccgggaccuacggcaccgggagcuggcccgacggcgccgaccugaaccugaugcccaucuga

SEQ ID NO: 25376 - RNA, 1410 nt, Artificial Sequence
  derived and/or modified CDS sequence (AUadapt) from InfluenzaA__AFN19482__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccaaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggagcgcgcagcacguggaggagugcuccugcuacccccgguacccgggcguccgcugcgugugccgggacaacuggaaggggucgaaccgccccaucguggacaucaacaucaaggaccacuccaucgucagcuccuacgugugcucgggccuggugggcgacaccccgcggaagaacgacuccagcuccucgucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagucgaagcugcagaucaaccgccaggugaucguggaccgguccgaccgcagcggcuacuccgggaucuucucggucgagggcaagagcugcaucaaccggugcuucuacguggagcugauccgcgggcggaaggaggagaccgaggugcucuggaccuccaacucgaucgucguguucugcggcacguccggcaccuacgggaccggcagcuggcccgacggggccgaccugaaccugaugcccaucuga

SEQ ID NO: 25377 - RNA, 1410 nt, Artificial Sequence; identical to SEQ ID NO: 16339
  derived and/or modified CDS sequence (AUadapt) from InfluenzaA__AFN19484__NA

SEQ ID NO: 25378 - RNA, 1410 nt, Artificial Sequence; identical to SEQ ID NO: 25324
  derived and/or modified CDS sequence (AUadapt) from InfluenzaA__AFN19488__NA

SEQ ID NO: 25379 - RNA, 1410 nt, Artificial Sequence
  derived and/or modified CDS sequence (AUadapt) from InfluenzaA__AFN19492__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggaagcucguggacuccguggucagcugguccaaggagauccugcggacccaggagucggagugcgugugcaucaacggcacgugcaccguggucaugaccgacggguccgccagcggcaaggccgacaccaagauccuguucaucgaggagggcaagaucgugcacacgucgacccucuccgggucggcgcagcacguggaggagugcuccugcuacccccgcuacccgggcguccggugcgugugccgcgacaacuggaaggggagcaaccggcccaucguggacaucaacaucaaggaccacuccaucgucucguccuacgugugcagcggccuggugggcgacaccccgcgcaagaacgacuccucguccagcucccacugccuggaccccaacaacgaggagggcgggcacggggucaagggcugggccuucgacgacgggaacgacguguggaugggccggaccaucaacgagacgucgcgccucggcuacgagaccuucaaggucaucgaggggugguccaaccccaagagcaagcugcagaucaaccgccaggugaucguggaccggggcgaccgguccggguacucgggcaucuucuccgucgagggcaagagcugcaucaaccgcugcuucuacguggagcugauccgggggcgcaaggaggagaccgaggugcucuggaccucgaacuccaucgucguguucugcggcacgagcgggaccuacggcaccggguccuggcccgacggcgccgaccugaaccugaugcccaucuga

SEQ ID NO: 25380 - RNA, 1410 nt, Artificial Sequence
  derived and/or modified CDS sequence (AUadapt) from InfluenzaA__AFN19494__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacaugcacuccaacaacaccgugcgcgaccggaccccguaccgcacccugcucaugaacgagcugggcguccccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucaacgagaccucgcggcugggcuacgagaccuucaaggugaucgaggggugguccaaccccaagagcaagcugcagaucaaccgccaggucaucguggaccggggcaaccgcuccggguacucgggcaucuucuccguggagggcaagagcugcaucaaccggugcuucuacgucgagcucauccgcgggcggaaggaggagaccgaggugcuguggaccucgaacuccaucguggucuucugcggcacgagcgggaccuacggcaccggguccuggccggacggcgccgaccugaaccucaugcccaucuga

SEQ ID NO: 25381 - RNA, 1410 nt, Artificial Sequence; identical to SEQ ID NO: 24189
  derived and/or modified CDS sequence (AUadapt) from InfluenzaA__AFN19496__NA

SEQ ID NO: 25382 - RNA, 1410 nt, Artificial Sequence
  derived and/or modified CDS sequence (AUadapt) from InfluenzaA__AFN19498__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcugcagaucaaccgccaggugaucguggaccggggcaaccgguccggguacucgggcaucuucuccgucgagggcaagagcugcaucaaccgcugcuucuacguggagcucauccgggggcgcaccgaggagaccgaggugcuguggacgucgaacuccaucgucguguucugcggcaccagcgggaccuacggcaccggguccuggccggacggcgccgaccugaaccucaugcccaucuga

SEQ ID NO: 25383 - RNA, 1410 nt, Artificial Sequence; identical to SEQ ID NO: 25332
  derived and/or modified CDS sequence (AUadapt) from InfluenzaA__AFN19500__NA

SEQ ID NO: 25384 - RNA, 1410 nt, Artificial Sequence; identical to SEQ ID NO: 25324
  derived and/or modified CDS sequence (AUadapt) from InfluenzaA__AFN19502__NA

SEQ ID NO: 25385 - RNA, 1410 nt, Artificial Sequence; identical to SEQ ID NO: 21920
  derived and/or modified CDS sequence (AUadapt) from InfluenzaA__AFN19504__NA

SEQ ID NO: 25386 - RNA, 1410 nt, Artificial Sequence; identical to SEQ ID NO: 21920
  derived and/or modified CDS sequence (AUadapt) from InfluenzaA__AFN19506__NA

SEQ ID NO: 25387 - RNA, 1410 nt, Artificial Sequence; identical to SEQ ID NO: 25332
  derived and/or modified CDS sequence (AUadapt) from InfluenzaA__AFN19508__NA

SEQ ID NO: 25388 - RNA, 1410 nt, Artificial Sequence; identical to SEQ ID NO: 25324
  derived and/or modified CDS sequence (AUadapt) from InfluenzaA__AFN19510__NA

SEQ ID NO: 25389 - RNA, 1410 nt, Artificial Sequence; identical to SEQ ID NO: 25324
  derived and/or modified CDS sequence (AUadapt) from InfluenzaA__AFN19512__NA

SEQ ID NO: 25390 - RNA, 1410 nt, Artificial Sequence; identical to SEQ ID NO: 25324
  derived and/or modified CDS sequence (AUadapt) from InfluenzaA__AFN19516__NA

SEQ ID NO: 25391 - RNA, 1410 nt, Artificial Sequence; identical to SEQ ID NO: 25332
  derived and/or modified CDS sequence (AUadapt) from InfluenzaA__AFN19518__NA

SEQ ID NO: 25392 - RNA, 1410 nt, Artificial Sequence; identical to SEQ ID NO: 25332
  derived and/or modified CDS sequence (AUadapt) from InfluenzaA__AFN19520__NA

SEQ ID NO: 25393 - RNA, 1410 nt, Artificial Sequence; identical to SEQ ID NO: 25324
  derived and/or modified CDS sequence (AUadapt) from InfluenzaA__AFN19522__NA

SEQ ID NO: 25394 - RNA, 1410 nt, Artificial Sequence
  derived and/or modified CDS sequence (AUadapt) from InfluenzaA__AFN19524__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggagcgcgcagcacguggaggagugcuccugcuacccccgguacccgggcguccgcugcgugugccgggacaacuggaaggggucgaaccgccccaucguggacaucaacaucaaggaccacuccaucgucagcuccuacgugugcucgggccuggugggcgacaccccgcggaagaacgacuccagcuccucgucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagucgaagcugcagaucaaccgccaggugaucguggaccggggcgaccgcuccggguacagcggcaucuucuccgucgagggcaagucgugcaucaaccggugcuucuacguggagcugauccgcgggcggaaggaggagaccgaggugcucuggaccagcaacuccaucgucguguucugcggcacgucggggaccuacggcaccggguccuggcccgacggcgccgaccugagccugaugcccaucuga

SEQ ID NO: 25395 - RNA, 1410 nt, Artificial Sequence
  derived and/or modified CDS sequence (AUadapt) from InfluenzaA__AFN19526__NA
augaaccccaaccagaagaucaucaccaucggcucggugucccugaccaucucgacgaucugcuucuucaugcagaucgccauccucaucaccaccgucacccugcacuucaagcagugcgaguucaacuccccgcccaacaaccaggugaugcugugcgagcccacgaucaucgagcgcaacaucaccgagaucguguaccucaccaacaccacgaccgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggacgacccucaacaacgugcacuccaacaacaccguccgcgaccggacccccuaccgcacgcugcugaugaacgagcucggcgugcccuuccaccugggcaccaagcaggucugcaucgccuggucguccucguccugccacgacgggaaggccuggcugcacgugugcaucaccggcgacgacaagaacgcgaccgccagcuucaucuacaacgggcggcucguggacuccguggucucgugguccaaggagauccugcgcacgcaggagagcgagugcgugugcaucaacgggaccugcaccguggucaugaccgacggguccgccucgggcaaggccgacacgaagauccuguucaucgaggagggcaagaucgugcacaccagcacccucuccgggucggcgcagcacguggaggagugcuccugcuacccccgguacccgggcguccgcugcgugugccgggacaacuggaaggggucgaaccgccccaucguggacaucaacaucaaggaccacuccaucgucagcuccuacgugugcucgggccuggugggcgacaccccgcggaagacggacuccagcuccucgucccacugccuggaccccaacaacgaggagggcggccacggggucaagggcugggccuucgacgacgggaacgacguguggaugggccgcaccaucaacgagaccucgcggcucggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagacggaggugcucuggaccucgaacuccaucgucguguucugcggcaccagcgggaccuacggcacgggguccuggcccgacggcgccgaccugaaccugaugcccaucuga

SEQ ID NO: 25396 - RNA, 1410 nt, Artificial Sequence
  derived and/or modified CDS sequence (AUadapt) from InfluenzaA__AFN19528__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaugaccgagaucguguaccucaccaacaccacgaucgagaaggagaucugccccaagccggccgaguaccggaacuggucgaagccccagugcgacaucaccggguucgcgcccuucuccaaggacaacagcauccgccuguccgccggcggggacaucugggucacccgggagcccuacgugucgugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccucguccugccacgacgggaaggccuggcugcacgugugcaucaccggcgacgacaagaacgcgaccgccagcuucaucuacaacgggcggcucguggacuccguggucucgugguccaaggagauccugcgcacccaggagagcgagugcgugugcaucaacggcacgugcaccguggucaugaccgacggguccgccucgggcaagagcgacaccaagauccuguucaucgaggagggcaagaucgugcacacguccacccucucgggguccgcccagcacguggaggagugcagcugcuacccccgguacccgggcguccgcugcgugugccgggacaacuggaagggguccaaccgccccaucguggacaucaacaucaaggaccacucgaucgucuccagcuacgugugcuccggccuggugggcgacacgccccggaagaacgacucguccagcuccucgcacugccuggaccccaacaacgaggagggcgggcacggggucaagggcugggcguucgacgacgggaacgacguguggaugggccgcaccaucaacgagaccucccggcucggcuacgagaccuucaaggucaucgagggguggagcaacccgaaguccaagcugcagaucaaccgccaggugaucguggaccggucggaccgcuccggcuacagcgggaucuucucggucgagggcaaguccugcaucaaccggugcuucuacguggagcugauccgcgggcggaaggaggagaccgaggugcucuggaccagcaacuccaucgucguguucugcggcacgagcggcaccuacgggaccggcuccuggcccgacggggccgaccugaaccugaugcccaucuga

SEQ ID NO: 25397 - RNA, 1410 nt, Artificial Sequence; identical to SEQ ID NO: 25360
  derived and/or modified CDS sequence (AUadapt) from InfluenzaA__AFN19530__NA

SEQ ID NO: 25398 - RNA, 1410 nt, Artificial Sequence; identical to SEQ ID NO: 25324
  derived and/or modified CDS sequence (AUadapt) from InfluenzaA__AFN19532__NA

SEQ ID NO: 25399 - RNA, 1410 nt, Artificial Sequence; identical to SEQ ID NO: 25360
  derived and/or modified CDS sequence (AUadapt) from InfluenzaA__AFN19534__NA

SEQ ID NO: 25400 - RNA, 1410 nt, Artificial Sequence; identical to SEQ ID NO: 25324
  derived and/or modified CDS sequence (AUadapt) from InfluenzaA__AFN19536__NA

SEQ ID NO: 25401 - RNA, 1410 nt, Artificial Sequence; identical to SEQ ID NO: 25324
  derived and/or modified CDS sequence (AUadapt) from InfluenzaA__AFN19538__NA

SEQ ID NO: 25402 - RNA, 1410 nt, Artificial Sequence; identical to SEQ ID NO: 25324
  derived and/or modified CDS sequence (AUadapt) from InfluenzaA__AFN19544__NA

SEQ ID NO: 25403 - RNA, 1410 nt, Artificial Sequence
  derived and/or modified CDS sequence (AUadapt) from InfluenzaA__AFN19546__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugucggagcucggcgugcccuuccaccuggggacgaagcaggucugcaucgccugguccagcuccucgugccacgacggcaaggccuggcugcacgugugcaucaccggggacgacaagaacgcgaccgccuccuucaucuacaacggccggcucguggacagcguggucuccuggucgaaggagauccugcgcacccaggaguccgagugcgugugcaucaacgggacgugcaccguggucaugaccgacggcagcgccucgggcaaggccgacaccaagauccuguucaucgaggaggggaagaucgugcacacguccacccucagcggcuccgcgcagcacguggaggagugcucgugcuacccccgguacccggggguccgcugcgugugccgggacaacuggaagggcuccaaccgccccaucguggacaucaacaucaaggaccacagcaucgucuccucguacgugugcuccggccuggugggggacacgccccggaagaacgacagcuccucguccagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggucgaacccgaaguccaagcugcagaucaaccgccaggugaucguggaccgcggggaccggagcggcuacuccgggaucuucucggucgagggcaagagcugcaucaaccggugcuucuacguggagcugauccgcggccggaaggaggagaccgaggugcucuggaccuccaacucgaucgucguguucugcgggacguccggcaccuacgggaccggcagcuggcccgacggggccgaccugaaccugaugcccaucuga

SEQ ID NO: 25404 - RNA, 1410 nt, Artificial Sequence
  derived and/or modified CDS sequence (AUadapt) from InfluenzaA__AFN19548__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggucgaagccccagugcgacaucaccggguucgcgcccuucuccaaggacaacagcauccgccuguccgccggcggggacaucugggucacccgggagcccuacgugucgugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccucguccugccacgacgggaaggccuggcugcacgugugcaucaccggcgacgacaagaacgcgaccgccagcuucaucuacaacgggcggcucguggacuccguggucucgugguccaaggagauccugcgcacccaggagagcgagugcgugugcaucaacggcacgugcaccguggucaugaccgacggguccgccucgggcaaggccgacaccaagauccuguucaucgaggagggcaagaucgugcacacgagcacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacacgccccggaagaacgacuccuucucguccagccacugccuggaccccaacaacgaggagggcgggcacggggucaagggcugggccuucgacgacgggaacgacguguggaugggccgcaccaucaacgagaccucccggcucggcuacgagaccuucaaggucaucgagggguggucgaacccgaaguccaagcugcagaucaaccgccaggugaucguggaccggggcgaccgcagcggguacuccggcaucuucucggucgaggggaaguccugcaucaaccggugcuucuacguggagcugauccgcggccggaaggaggagaccgaggugcucuggaccagcaacucgaucgucguguucugcggcacguccgggaccuacggcaccgggagcuggcccgacggcgccgaccugaaccugaugcccaucuga

SEQ ID NO: 25405 - RNA, 1410 nt, Artificial Sequence
  derived and/or modified CDS sequence (AUadapt) from InfluenzaA__AFN19550__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcgaggccgacaccaagauccucuucaucgaggagggcaagaucauccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucaacgagaccucgcggcugggcuacgagaccuucaaggugaucgaggggugguccaaccccaagagcaagcugcagaucaaccgccaggucaucguggaccggggcaaccgcuccggguacucgggcaucuucuccguggagggcaagagcugcaucaaccggugcuucuacgucgagcucauccgcgggcggaaggaggagaccgaggugcuguggaccucgaacuccaucguggucuucugcggcacgagcgggaccuacggcaccggguccuggccggacggcgccgaccugaaccucaugcccaucuga

SEQ ID NO: 25406 - RNA, 1410 nt, Artificial Sequence; identical to SEQ ID NO: 25324
  derived and/or modified CDS sequence (AUadapt) from InfluenzaA__AFN19552__NA

SEQ ID NO: 25407 - RNA, 1410 nt, Artificial Sequence; identical to SEQ ID NO: 16339
  derived and/or modified CDS sequence (AUadapt) from InfluenzaA__AFN19554__NA

SEQ ID NO: 25408 - RNA, 1410 nt, Artificial Sequence; identical to SEQ ID NO: 16339
  derived and/or modified CDS sequence (AUadapt) from InfluenzaA__AFN19556__NA

SEQ ID NO: 25409 - RNA, 1410 nt, Artificial Sequence
  derived and/or modified CDS sequence (AUadapt) from InfluenzaA__AFN19558__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcgggcacggggucaagggcugggccuucgacgacgggaacgacguguggaugggccgcaccaucaacgagacgucgcggcucggcuacgagaccuucaaggucaucgaggggugguccaaccccaagagcaagcugcagaugaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcccaucuga

SEQ ID NO: 25410 - RNA, 1410 nt, Artificial Sequence
  derived and/or modified CDS sequence (AUadapt) from InfluenzaA__AFN19560__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgagggcgggggccacggggucaagggcugggccuucgacgacggcaacgacguguggauggggcgcaccaucaacgagacgucgcggcucggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcccaucuga

SEQ ID NO: 25411 - RNA, 1410 nt, Artificial Sequence; identical to SEQ ID NO: 25371
  derived and/or modified CDS sequence (AUadapt) from InfluenzaA__AFN19562__NA

SEQ ID NO: 25412 - RNA, 1410 nt, Artificial Sequence
  derived and/or modified CDS sequence (AUadapt) from InfluenzaA__AFN19564__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaccgacuccucguccagcucccacugccuggaccccaacaacgaggagggcgggcacggcgucaaggggugggccuucgacgacggcaacgacguguggaugggccgcacgaucaacgagaccucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggacgucgaacuccaucgucguguucugcgggaccagcggcaccuacgggaccggcuccuggcccgacggggccgaccugaaccugaugcccaucuga

SEQ ID NO: 25413 - RNA, 1410 nt, Artificial Sequence
  derived and/or modified CDS sequence (AUadapt) from InfluenzaA__AFN19566__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaacgagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaacgaggugcucuggaccucgaacuccaucgucguguucugcgggaccagcggcacguacgggaccggcuccuggcccgacggggccgaccugaaccugaugcccaucuga

SEQ ID NO: 25414 - RNA, 1410 nt, Artificial Sequence
  derived and/or modified CDS sequence (AUadapt) from InfluenzaA__AFN19568__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggucgaagccccagugcgggaucaccggcuucgcgcccuucuccaaggacaacagcauccgccuguccgccgggggcgacaucugggucacccgggagcccuacgugucgugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccucguccugccacgacggcaaggccuggcugcacgugugcaucaccggggacgacaagaacgcgaccgccagcuucaucuacaacggccggcucguggacuccguggucucgugguccaaggagauccugcgcacccaggagagcgagugcgugugcaucaacgggacgugcaccguggucaugaccgacggcuccgccucgggcaaggccgacaccaagauccuguucaucgaggaggggaagaucgugcacacgagcacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcuccaggugaaccgccaggugaucgucgaccgcggggaccgguccggcuacucggggaucuucuccguggagggcaagagcugcaucaaccggugcuucuacguggagcugauccgcggccggaaggaggagaucgagguccuguggaccucgaacuccaucgugguguucugcgggaccagcggcacguacgggaccggcuccuggcccgacggggccgaccugaaccugaugcccaucuga

SEQ ID NO: 25415 - RNA, 1410 nt, Artificial Sequence
  derived and/or modified CDS sequence (AUadapt) from InfluenzaA__AFN19570__NA
augaaccccaaccagaagaucaucaccaucggcucggugucccugaccaucucgacgaucugcuucuucaugcagaucgccauccucaucaccaccgucacccugcacuucaagcaguacgaguucaacuacccgcccaacaaccaggugaugcugugcgagcccacgaucaucgagcgcaacaucaccgagaucguguaccucaccaacaccacgaucgagaaggagaucugccccaagccggccgaguaccggaacugguccaagccccagugcgggaucaccggcuucgcgcccuucagcaaggacaacuccauccgccugucggccgggggcgacaucugggucacccgggagcccuacguguccugcgacccggacaagugcuaccaguucgcccuggggcagggcaccacgcucaacaacaugcacagcaacaacaccgugcgcgaccggacccccuaccgcacccugcugaugaacgagcucggcguccccuuccaccuggggacgaagcaggucugcaucgccugguccucguccagcugccacgacggcaaggccuggcugcacgugugcaucaccggggacgacaagaacgcgaccgccuccuucaucuacaacggccggcucguggacucggugguguccuggagcaacgagauccugcgcacccaggaguccgagugcgucugcaucaacgggacgugcaccguggugaugaccgacggcucggccuccggcaaggccgacaccaagauccuguucaucgaggaggggaagaucguccacacgagcacccucucgggcuccgcgcagcacguggaggagugcucgugcuacccccgguacccgggggugcgcugcgucugccgggacaacuggaagggcuccaaccgccccaucguggacaucaacaucaaggaccacagcaucguguccucguacgucugcuccggccuggugggggacacgccccggaagaacgacagcuccucguccagccacugccuggaccccaacaacgaggagggcgggcacggcgugaaggggugggccuucgacgacggcaacgacgucuggaugggccgcaccaucaacgagaccucccggcucggguacgagaccuucaaggugaucgagggcuggucgaacccgaaguccaagcugcagaucaaccgccaggucaucguggaccgcggggaccggagcggcuacuccgggaucuucucgguggagggcaaguccugcaucaaccggugcuucuacgucgagcugauccgcggccggaaggaggagaacgaggugcucuggaccagcaacucgaucguggucuucugcgggaccuccggcacguacgggaccggcagcuggcccgacggggccgaccugaaccugaugcccaucuga

SEQ ID NO: 25416 - RNA, 1410 nt, Artificial Sequence
  derived and/or modified CDS sequence (AUadapt) from InfluenzaA__AFN19572__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgcaucuccgccggcggggacaucugggucacccgggagcccuacgugagcugcgacccggacaagugcuaccaguucgcccugggccaggggaccacgcugaacaacgugcacuccaacaacaccguccgcgaccggacccccuaccgcacccuccugaugaacgagcugggcgugcccuuccaccucggcacgaagcaggucugcaucgccuggucguccagcuccugccacgacgggaaggccuggcugcacgugugcaucaccggcgacgacaagaacgcgaccgccucguucaucuacaacgggaagcugguggacuccguggucagcugguccaaggagauccuccggacccaggagucggagugcgugugcaucaacggcacgugcaccguggucaugaccgacggguccgccagcggcaaggccgacaccaagauccuguucaucgaggagggcaagaucgugcacacgucgacccuguccgggucggcgcagcacguggaggagugcuccugcuacccccgcuacccgggcguccggugcgugugccgcgacaacuggaaggggagcaaccggcccaucguggacaucaacaucaaggaccacuccaucgucucguccuacgugugcagcggccucgugggcgacaccccgcgcaagaacgacuccucguccagcucccacugccuggaccccaacaacgaggagggcgggcacggggucaagggcugggccuucgacgacgggaacgacguguggaugggccggaccaucaacgagacgucgcgccugggcuacgagaccuucaaggucaucgaggggugguccaaccccaagagcaagcuccagaucaaccgccaggugaucguggaccggggcgaccgguccggguacucgggcaucuucuccgucgagggcaagagcugcaucaaccgcugcuucuacguggagcugauccgggggcgcaaggaggagaccgaggugcuguggaccucgaacuccaucgucguguucugcggcacgagcgggaccuacggcaccggguccuggcccgacggcgccgaccucaaccugaugcccaucuga

SEQ ID NO: 25417 - RNA, 1410 nt, Artificial Sequence
  derived and/or modified CDS sequence (AUadapt) from InfluenzaA__AFN19574__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaagaagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaugaaggaccacuccaucgucagcuccuacgugugcucgggccuggugggcgacacgccccggaagaacgacuccagcuccucgucccacugcuucgaccccaacgacgaggagggcgggcacggggucaagggcugggccuucgacgacgggaacgacguguggaugggccgcaccaucagcgagaagucccggcucggcuacgagaccuucaaggucaucgagggguggagcaaccccaaguccaagcugcagaucaaccgccaggugaucguggaccggggcgaccgcucgggguacuccggcaucuucagcgucgagggcaagucgugcaucaaccggugcuucuacguggagcugauccgcggguccaaggaggagaccgaggugcucuggaccagcaacuccaucgucguguucugcggcaccagcgggacguacggcaccggguccuggccggacggcgccgacaucaaccugaugcccaucuga

SEQ ID NO: 25418 - RNA, 1410 nt, Artificial Sequence
  derived and/or modified CDS sequence (AUadapt) from InfluenzaA__AFN19576__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccagaugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggugacccgggagcccuacgucagcugcgacccggacaagugcuaccaguucgcccugggccaggggaccacgcucaacaacgugcacuccaacaacaccgugcgcgaccggacccccuaccgcacccugcugaugaacgagcucggcguccccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggugagcugguccaaggagauccugcgcacccaggagucggagugcgucugcaucaacggcacgugcaccguggugaugaccgacggguccgccagcggcaaggccgacaccaagauccuguucaucgaggagggcaagaucguccacacgucgacccucuccgggucggcgcagcacguggaggagugcuccugcuacccccgguacccgggcgugcgcugcgucugccgggacaacuggaaggggagcaaccgccccaucguggacaucaacaucaaggaccacuccaucgugucguccuacgucugcagcggccuggugggcgacaccccgcggaagaacgacuccucguccagcucccacugccuggaccccaacaacgaggagggcgggcacggggugaagggcugggccuucgacgacgggaacgacgucuggaugggccgcaccaucaacgagacgucgcggcucggcuacgagaccuucaaggugaucgaggggugguccaaccccaagagcaagcugcagaucaaccgccaggucaucguggaccggggcgaccgcuccggguacucgggcaucuucuccguggagggcaagagcugcaucaaccggugcuucuacgucgagcugauccgcgggcggaaggaggagaccgaggugcucuggaccucgaacuccaucguggucuucugcggcacgagcgggaccuacggcaccggguccuggcccgacggcgccgaccugaaccugaugcccaucuga

SEQ ID NO: 25419 - RNA, 1410 nt, Artificial Sequence; identical to SEQ ID NO: 25324
  derived and/or modified CDS sequence (AUadapt) from InfluenzaA__AFN19578__NA

SEQ ID NO: 25420 - RNA, 1410 nt, Artificial Sequence; identical to SEQ ID NO: 25324
  derived and/or modified CDS sequence (AUadapt) from InfluenzaA__AFN19582__NA

SEQ ID NO: 25421 - RNA, 1410 nt, Artificial Sequence; identical to SEQ ID NO: 25324
  derived and/or modified CDS sequence (AUadapt) from InfluenzaA__AFN19584__NA

SEQ ID NO: 25422 - RNA, 1410 nt, Artificial Sequence; identical to SEQ ID NO: 25324
  derived and/or modified CDS sequence (AUadapt) from InfluenzaA__AFN19588__NA

SEQ ID NO: 25423 - RNA, 1410 nt, Artificial Sequence; identical to SEQ ID NO: 25324
  derived and/or modified CDS sequence (AUadapt) from InfluenzaA__AFN19590__NA

SEQ ID NO: 25424 - RNA, 1410 nt, Artificial Sequence; identical to SEQ ID NO: 25360
  derived and/or modified CDS sequence (AUadapt) from InfluenzaA__AFN19592__NA

SEQ ID NO: 25425 - RNA, 1410 nt, Artificial Sequence; identical to SEQ ID NO: 25324
  derived and/or modified CDS sequence (AUadapt) from InfluenzaA__AFN19594__NA

SEQ ID NO: 25426 - RNA, 1410 nt, Artificial Sequence; identical to SEQ ID NO: 25332
  derived and/or modified CDS sequence (AUadapt) from InfluenzaA__AFN19596__NA

SEQ ID NO: 25427 - RNA, 1410 nt, Artificial Sequence; identical to SEQ ID NO: 25332
  derived and/or modified CDS sequence (AUadapt) from InfluenzaA__AFN19600__NA

SEQ ID NO: 25428 - RNA, 1410 nt, Artificial Sequence
  derived and/or modified CDS sequence (AUadapt) from InfluenzaA__AFN19602__NA
augaaccccaaccagaagaucaucaccaucggcucggugucccugacccucucgacgaucugcuucuucaugcagaucgccauccugaucaccaccgucacccugcacuucaagcaguacgaguucaacuccccgcccaacaaccaggugaugcucugcgagcccacgaucaucgagcgcaacaugaccgagaucguguaccugaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccucggccaggggaccacgcugaacaacgugcacuccaacaacaccguccgcgaccggacccccuaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguacccgggcguccgcugcgugugccgggacaacuggaaggggucgaaccgccccaucguggacaucaacaucaaggaccacuccaucgucagcuccuacgugugcucgggccuggugggcgacaccccgcggaagaacgacuccagcuccucgucccacugccucgaccccaacaacgaggagggcgggcacggggucaagggcugggccuucgacgacgggaacgacguguggaugggccgcaccaucaacgagacgagccggcugggcuacgagaccuucaaggucaucgaggggugguccaaccccaagucgaagcugcagaucaaccgccaggugaucguggaccgguccgaccgcagcggcuacuccgggaucuucucggucgagggcaagagcugcaucaaccggugcuucuacguggagcucauccgcgggcggaaggaggagaccgaggugcuguggaccuccaacucgaucgucguguucugcggcacguccggcaccuacgggaccggcagcuggcccgacggggccgaccugaaccucaugcccaucuga

SEQ ID NO: 25429 - RNA, 1410 nt, Artificial Sequence; identical to SEQ ID NO: 25324
  derived and/or modified CDS sequence (AUadapt) from InfluenzaA__AFN19604__NA

SEQ ID NO: 25430 - RNA, 1410 nt, Artificial Sequence; identical to SEQ ID NO: 25324
  derived and/or modified CDS sequence (AUadapt) from InfluenzaA__AFN19606__NA

SEQ ID NO: 25431 - RNA, 1410 nt, Artificial Sequence; identical to SEQ ID NO: 25324
  derived and/or modified CDS sequence (AUadapt) from InfluenzaA__AFN19608__NA

SEQ ID NO: 25432 - RNA, 1410 nt, Artificial Sequence; identical to SEQ ID NO: 25324
  derived and/or modified CDS sequence (AUadapt) from InfluenzaA__AFN19610__NA

SEQ ID NO: 25433 - RNA, 1410 nt, Artificial Sequence; identical to SEQ ID NO: 25332
  derived and/or modified CDS sequence (AUadapt) from InfluenzaA__AFN19612__NA

SEQ ID NO: 25434 - RNA, 1410 nt, Artificial Sequence; identical to SEQ ID NO: 16339
  derived and/or modified CDS sequence (AUadapt) from InfluenzaA__AFN19614__NA

SEQ ID NO: 25435 - RNA, 1410 nt, Artificial Sequence
  derived and/or modified CDS sequence (AUadapt) from InfluenzaA__AFN19618__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaacgagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 25436 - RNA, 1410 nt, Artificial Sequence; identical to SEQ ID NO: 25324
  derived and/or modified CDS sequence (AUadapt) from InfluenzaA__AFN19620__NA

SEQ ID NO: 25437 - RNA, 1410 nt, Artificial Sequence; identical to SEQ ID NO: 25360
  derived and/or modified CDS sequence (AUadapt) from InfluenzaA__AFN19624__NA

SEQ ID NO: 25438 - RNA, 1410 nt, Artificial Sequence; identical to SEQ ID NO: 25324
  derived and/or modified CDS sequence (AUadapt) from InfluenzaA__AFN19630__NA

SEQ ID NO: 25439 - RNA, 1410 nt, Artificial Sequence
  derived and/or modified CDS sequence (AUadapt) from InfluenzaA__AFN19632__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccgaccgaguaccggaacuggagcaagccccagugcgacaucaccggguucgcccccuucuccaaggacaacucgauccgccuguccgcgggcggggacaucugggucacccgggagcccuacgugagcugcgacccggacaagugcuaccaguucgcccugggccaggggacgacccucaacaacgugcacuccaacaacaccguccgcgaccggacccccuaccgcacgcugcugaugaacgagcucggcgugcccuuccaccugggcaccaagcaggucugcaucgccuggucguccagcuccugccacgacgggaaggccuggcugcacgugugcaucaccggcgacgacaagaacgccaccgcgucguucaucuacaacgggcggcucguggacuccguggucagcugguccaaggagauccugcgcacgcaggagucggagugcgugugcaucaacgggaccugcaccguggucaugaccgacggguccgccagcggcaaggccgacacgaagauccuguucaucgaggagggcaagaucgugcacaccucgacccucuccgggucggcccagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcggccacggggucaagggcugggcguucgacgacgggaacgacguguggaugggccgcacgaucaacgagaccucgcggcucggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggacgucgaacuccaucgucguguucugcggcaccagcgggaccuacggcaccggguccuggcccgacggcgccgaccugaaccugaugcccaucuga

SEQ ID NO: 25440 - RNA, 1410 nt, Artificial Sequence
  derived and/or modified CDS sequence (AUadapt) from InfluenzaA__AFN19634__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggaccucguaccgcacccugcugaugaacgagcucggcgugcccuuccaccugggcacgaagcaggucugcaucgccugguccagcuccucgugccacgacgggaaggccuggcugcacgugugcaucaccggcgacgacaagaacgcgaccgccuccuucaucuacaacgggcggcucguggacagcguggucuccuggucgaaggagauccugcgcacccaggaguccgagugcgugugcaucaacggcacgugcaccguggucaugaccgacgggagcgccucgggcaaggccgacaccaagauccuguucaucgaggagggcaagaucgugcacacguccacccucagcggguccgcgcagcacguggaggagugcucgugcuacccccgguaccccggcguccgcugcgugugccgggacaacuggaagggguccaaccgcccgaucguggacaucaacaucaaggaccacagcaucgucuccucguacgugugcuccggccuggugggcgacacgccccggaagaacgacagcuccucguccagccacugccuggaccccaacaacgaggagggcgggcacggggucaagggcugggccuucgacgacgggaacgacguguggaugggccgcaccaucaacgagaccucccggcucggcuacgagaccuucaaggucaucgagggguggucgaaccccaaguccaagcugcagaucaaccgccaggugaucguggaccggggcgaccgcagcggguacuccggcaucuucucggucgagggcaagagcugcaucaaccggugcuucuacguggagcugauccgcgggcggaaggaggagaccgaggugcucuggaccuccaacucgaucgucguguucugcggcacguccgggaccuacggcaccgggagcuggccggacggcgccgaccugaaccugaugcccaucuga

SEQ ID NO: 25441 - RNA, 1410 nt, Artificial Sequence
  derived and/or modified CDS sequence (AUadapt) from InfluenzaA__AFN19636__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccaucaucgagaaggagaucugccccaagccgacggaguaccggaacuggucgaagccccagugcgacaucaccggguucgcccccuucuccaaggacaacagcauccgccuguccgcgggcggggacaucugggucacccgggagcccuacgugucgugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccucguccugccacgacgggaaggccuggcugcacgugugcaucaccggcgacgacaagaacgccaccgcgagcuucaucuacaacgggcggcucguggacuccguggucucgugguccaaggagauccugcgcacccaggagagcgagugcgugugcaucaacggcacgugcaccguggucaugaccgacggguccgccucgggcaaggccgacaccaagauccuguucaucgaggagggcaagaucgugcacacgagcacccucuccgggucggcccagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcgggcacggggucaagggcugggcguucgacgacgggaacgacguguggaugggccgcaccaucaacgagacgucgcggcucggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcccaucuga

SEQ ID NO: 25442 - RNA, 1410 nt, Artificial Sequence; identical to SEQ ID NO: 25441
  derived and/or modified CDS sequence (AUadapt) from InfluenzaA__AFN19638__NA

SEQ ID NO: 25443 - RNA, 1410 nt, Artificial Sequence; identical to SEQ ID NO: 25324
  derived and/or modified CDS sequence (AUadapt) from InfluenzaA__AFN19640__NA

SEQ ID NO: 25444 - RNA, 1410 nt, Artificial Sequence
  derived and/or modified CDS sequence (AUadapt) from InfluenzaA__AFN19642__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaugaccgagaucguguaccucaccaacaccacgaucgagaaggagaucugccccaagccggccgaguaccggaacuggucgaagccccagugcgacaucaccggguucgcgcccuucuccaaggacaacagcauccgccuguccgccggcggggacaucugggucacccgggagcccuacgugucgugcgacccggacaagugcuaccaguucgcccugggccaggggaccacgcucaacaacgugcacuccaacaacaccgucagcgaccgcacccccuaccggacccugcugaugaacgagcucggcgugcccuuccaccugggcacgaagcaggucugcaucgccugguccucguccagcugccacgacgggaaggccuggcugcacgugugcaucaccggcgacgacaagaacgcgaccgccuccuucaucuacaacgggcgccucguggacucgguggucuccuggagcaaggagauccugcggacccaggaguccgagugcgugugcaucaacggcacgugcaccguggucaugaccgacgggucggccagcggcaaggccgacaccaagauccuguucaucgaggagggcaagaucgugcacacguccacccucucgggguccgcgcagcacguggaggagugcagcugcuacccccgcuacccgggcguccggugcgugugccgcgacaacuggaagggguccaaccggcccaucguggacaucaacaucaaggaccacucgaucgucuccagcuacgugugcuccggccuggugggcgacacgccccgcaagaacgacucguccagcuccucgcacugccuggaccccaacaacgaggagggcgggcacggggucaagggcugggccuucgacgacgggaacgacguguggaugggccggaccaucaacgagaccucccgccucggcuacgagaccuucaaggucaucgagggguggagcaacccgaaguccaagcugcagaucaaccgccaggugaucguggaccggucggaccgguccggcuacagcgggaucuucucggucgagggcaaguccugcaucaaccgcugcuucuacguggagcugauccgggggcgcaaggaggagaccgaggugcucuggaccagcaacuccaucgucguguucugcggcacgagcggcaccuacgggaccggcuccuggcccgacggggccgaccugaaccugaugcccaucuga

SEQ ID NO: 25445 - RNA, 1410 nt, Artificial Sequence; identical to SEQ ID NO: 25441
  derived and/or modified CDS sequence (AUadapt) from InfluenzaA__AFN19644__NA

SEQ ID NO: 25446 - RNA, 1410 nt, Artificial Sequence
  derived and/or modified CDS sequence (AUadapt) from InfluenzaA__AFN19646__NA
augaaccccaaccagaagaucaucaccaucggcucggugucccugaccaucucgacgaucugcuucuucauccagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggagcgcgcagcacguggaggagugcuccugcuacccccgguacccgggcguccgcugcgugugccgggacaacuggaaggggucgaaccgccccaucguggacaucaacaucaaggaccacuccaucgucagcuccuacgugugcucgggccuggugggcgacaccccgcggaagaacgacuccagcuccucgucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagucgaagcugcagaucaaccgccaggugaucgugaaccgguccgaccgcagcggcuacuccgggaucuucucggucgagggcaagagcugcaucaaccggugcuucuacguggagcugauccgcgggcggaaggaggagaccgaggugcucuggaccuccaacucgaucgucguguucugcggcacguccggcaccuacgggaccggcagcuggcccgacggggccgaccugaaccugaugcccaucuga

SEQ ID NO: 25447 - RNA, 1410 nt, Artificial Sequence; identical to SEQ ID NO: 25324
  derived and/or modified CDS sequence (AUadapt) from InfluenzaA__AFN19648__NA

SEQ ID NO: 25448 - RNA, 1410 nt, Artificial Sequence; identical to SEQ ID NO: 25360
  derived and/or modified CDS sequence (AUadapt) from InfluenzaA__AFN19650__NA

SEQ ID NO: 25449 - RNA, 1410 nt, Artificial Sequence
  derived and/or modified CDS sequence (AUadapt) from InfluenzaA__AFN19652__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagguggucuaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggugacccgggagcccuacgugagcugcgacccggacaagugcuaccaguucgcccugggccaggggaccacgcucaacaacguccacuccaacaacaccgugcgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccgucgugagcugguccaaggagauccugcgcacccaggagucggagugcgugugcaucaacggcacgugcaccgucgugaugaccgacggguccgccagcggcaaggccgacaccaagauccuguucaucgaggagggcaagaucgugcacacgucgacccucuccgggucggcgcagcacgucgaggagugcuccugcuacccccgguacccgggcgugcgcugcgugugccgggacaacuggaaggggagcaaccgccccaucgucgacaucaacaucaaggaccacuccaucgugucguccuacgugugcagcggccuggucggcgacaccccgcggaagaacgacuccucguccagcucccacugccuggaccccaacaacgaggagggcgggcacggggugaagggcugggccuucgacgacgggaacgacgucuggaugggccgcaccaucaacgagacgucgcggcucggcuacgagaccuucaaggugaucgaggggugguccaaccccaagagcaagcugcagaucaaccgccaggugaucgucgaccggggcgaccgcuccggguacucgggcaucuucuccguggagggcaagagcugcaucaaccggugcuucuacguggagcugauccgcgggcggaaggaggagaccgagguccucuggaccucgaacuccaucgugguguucugcggcacgagcgggaccuacggcaccggguccuggcccgacggcgccgaccugaaccugaugcccaucuga

SEQ ID NO: 25450 - RNA, 1410 nt, Artificial Sequence
  derived and/or modified CDS sequence (AUadapt) from InfluenzaA__AFN19654__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaccugccccaagccgaccgaguaccggaacuggagcaagccccagugcgacaucaccggguucgcccccuucuccaaggacaacucgauccgccuguccgcgggcggggacaucugggucacgcgggagcccuacgugagcugcgacccggacaagugcuaccaguucgcccugggccaggggaccacccucaacaacgugcacuccaacaacaccguccgcgaccggacgcccuaccgcacccugcugaugaacgagcucggcgugcccuuccaccugggcaccaagcaggucugcaucgccuggucguccucguccugccacgacgggaaggccuggcugcacgugugcaucaccggcgacgacaagaacgccacggcgagcuucaucuacaacgggcggcucguggacuccguggucucgugguccaaggagauccugcgcacccaggagagcgagugcgugugcaucaacgggaccugcaccguggucaugacggacggguccgccucgggcaaggccgacaccaagauccuguucaucgaggagggcaagaucgugcacaccagcacccucuccgggucggcccagcacguggaggagugcuccugcuacccccgguacccgggcguccgcugcgugugccgggacaacuggaaggggucgaaccgccccaucguggacaucaacaucaaggaccacuccaucgucagcuccuacgugugcucgggccuggugggcgacacgccccggaagaacgacuccagcuccucgucccacugccuggaccccaacaacgaggagggcggccacggggucaagggcugggcguucgacgacgggaacgacguguggaugggccgcaccaucaacgagaccucgcggcucggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagacggaggugcucuggaccucgaacuccaucgucguguucugcggcaccagcgggaccuacggcacgggguccuggccggacggcgccgaccugaaccugaugcccaucuga

SEQ ID NO: 25451 - RNA, 1410 nt, Artificial Sequence; identical to SEQ ID NO: 25324
  derived and/or modified CDS sequence (AUadapt) from InfluenzaA__AFN19656__NA

SEQ ID NO: 25452 - RNA, 1410 nt, Artificial Sequence; identical to SEQ ID NO: 16339
  derived and/or modified CDS sequence (AUadapt) from InfluenzaA__AFN19658__NA

SEQ ID NO: 25453 - RNA, 1410 nt, Artificial Sequence; identical to SEQ ID NO: 25441
  derived and/or modified CDS sequence (AUadapt) from InfluenzaA__AFN19660__NA

SEQ ID NO: 25454 - RNA, 1410 nt, Artificial Sequence; identical to SEQ ID NO: 16339
  derived and/or modified CDS sequence (AUadapt) from InfluenzaA__AFN19662__NA

SEQ ID NO: 25455 - RNA, 1410 nt, Artificial Sequence
  derived and/or modified CDS sequence (AUadapt) from InfluenzaA__AFN19664__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaacaccaucgagaaggagaucugccccaagccggccgaguaccggaacuggagcaagccccagugcgggaucacgggcuucgcgcccuucuccaaggacaacucgauccgccuguccgccgggggcgacaucugggucacccgggagcccuacgugagcugcgacccggacaagugcuaccaguucgcccuggggcagggcaccacccucaacaacgugcacuccaacaacacgguccgcgaccggacccccuaccgcacccugcugaugaacgagcucggcgugcccuuccaccuggggaccaagcaggucugcaucgccuggucguccagcuccugccacgacggcaaggccuggcugcacgugugcaucacgggggacgacaagaacgcgaccgccucguucaucuacaacggccggcucguggacuccguggucagcugguccaaggagauccugcgcacccaggagucggagugcgugugcaucaacgggaccugcacgguggucaugaccgacggcuccgccagcggcaaggccgacaccaagauccuguucaucgaggaggggaagaucgugcacaccucgacgcucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagaccucgcggcucggguacgagacguucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggaccagcggcacguacgggaccggcuccuggcccgacggggccgaccugaaccugaugcccaucuga

SEQ ID NO: 25456 - RNA, 1410 nt, Artificial Sequence
  derived and/or modified CDS sequence (AUadapt) from InfluenzaA__AFN19666__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaugaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggagcgcgcagcacguggaggagugcuccugcuacccccgguacccgggcguccgcugcgugugccgggacaacuggaaggggucgaaccgccccaucguggacaucaacaucaaggaccacuccaucgucagcuccuacgugugcucgggccuggugggcgacaccccgcggaagaacgacuccagcuccucgucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagucgaagcugcagaucaaccgccaggugaucgugaaccgguccgaccgcagcggcuacuccgggaucuucucggucgagggcaagagcugcaucaaccggugcuucuacguggagcugauccgcgggcggaaggaggagaccgaggugcucuggaccuccaacucgaucgucguguucugcggcacguccggcaccuacgggaccggcagcuggcccgacggggccgaccugaaccugaugcccaucuga

SEQ ID NO: 25457 - RNA, 1410 nt, Artificial Sequence
  derived and/or modified CDS sequence (AUadapt) from InfluenzaA__AFN19668__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaugaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgagcacuccaacaacaccgugcgcgaccggacccccuaccgcacccugcugaugaacgagcucggcguccccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggugucgugguccaaggagauccugcgcacccaggagagcgagugcgucugcaucaacggcacgugcaccguggugaugaccgacggguccgccucgggcaaggccgacaccaagauccuguucaucgaggagggcaagaucguccacacgagcacccucuccgggucggcgcagcacguggaggagugcuccugcuacccccgguacccgggcgugcgcugcgucugccgggacaacuggaaggggagcaaccgccccaucguggacaucaacaucaaggaccacuccaucgugucguccuacgucugcagcggccuggugggcgacaccccgcggaagaacgacuccucguccucgucccacugccuggaccccaacaacgaggagggcgggcacggggugaagggcugggccuucgacgacgggaacgacgucuggaugggccgcaccaucaacgagacgagccggcucggcuacgagaccuucaaggugaucgaggggugguccaaccccaagucgaagcugcagaucaaccgccaggucaucguggaccgguccgaccgcagcggcuacuccgggaucuucucgguggagggcaagagcugcaucaaccggugcuucuacgucgagcugauccgcgggcggaaggaggagaccgaggugcucuggaccuccaacucgaucguggucuucugcggcacguccggcaccuacgggaccggcagcuggcccgacggggccgaccugaaccugaugcccaucuga

SEQ ID NO: 25458 - RNA, 1410 nt, Artificial Sequence; identical to SEQ ID NO: 25360
  derived and/or modified CDS sequence (AUadapt) from InfluenzaA__AFN19670__NA

SEQ ID NO: 25459 - RNA, 1410 nt, Artificial Sequence; identical to SEQ ID NO: 16339
  derived and/or modified CDS sequence (AUadapt) from InfluenzaA__AFN19673__NA

SEQ ID NO: 25460 - RNA, 1410 nt, Artificial Sequence; identical to SEQ ID NO: 25324
  derived and/or modified CDS sequence (AUadapt) from InfluenzaA__AFN19675__NA

SEQ ID NO: 25461 - RNA, 1410 nt, Artificial Sequence
  derived and/or modified CDS sequence (AUadapt) from InfluenzaA__AFN19677__NA
augaaccccaaccagaagaucaucaccaucggcucggugucccugaccaucagcaucaucugcuucuucaugcagaucgccauccucaucacgaccgucacccugcacuucaagcaguacgaguucaacuccccgcccaacaaccaggugaugcugugcgagcccaccaucaucgagcgcaacaucacggagaucguguaccucaccaacaccaccaucgagaaggagaucugccccaagccggccgaguaccggaacuggucgaagccccagugcgacaucacgggguucgcgcccuucuccaaggacaacagcauccgccuguccgccggcggggacaucugggucacccgggagcccuacgugucgugcgacccggacaagugcuaccaguucgcccugggccaggggaccacccucaacaacgugcacuccaacaacacgguccgcgaccggacccccuaccgcacccugcugaugaacgagcucggcgugcccuuccaccugggcaccaagcaggucugcaucgccuggagcuccucguccugccacgacgggaaggccuggcugcacgugugcaucacgggcgacgacaagaacgcgaccgccagcuucaucuacaacgggcggcucguggacuccguggucucgugguccaaggagauccugcgcacccaggagagcgagugcgugugcaucaacgggaccugcacgguggucaugaccgacggguccgccucgggcaaggccgacaccaagauccuguucaucgaggagggcaagaucgugcacaccagcacgcucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcggccacggggucaagggcugggccuucgacgacgggaacgacguguggaugggccgcaccaucaacgagaccucgcggcucggcuacgagacguucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcaccagcgggacguacggcaccggguccuggcccgacggcgccgaccugaaccugaugcccaucuga

SEQ ID NO: 25462 - RNA, 1410 nt, Artificial Sequence; identical to SEQ ID NO: 25360
  derived and/or modified CDS sequence (AUadapt) from InfluenzaA__AFN19683__NA

SEQ ID NO: 25463 - RNA, 1410 nt, Artificial Sequence; identical to SEQ ID NO: 25324
  derived and/or modified CDS sequence (AUadapt) from InfluenzaA__AFN19685__NA

SEQ ID NO: 25464 - RNA, 1410 nt, Artificial Sequence; identical to SEQ ID NO: 25324
  derived and/or modified CDS sequence (AUadapt) from InfluenzaA__AFN19687__NA

SEQ ID NO: 25465 - RNA, 1410 nt, Artificial Sequence; identical to SEQ ID NO: 25324
  derived and/or modified CDS sequence (AUadapt) from InfluenzaA__AFN19689__NA

SEQ ID NO: 25466 - RNA, 1410 nt, Artificial Sequence; identical to SEQ ID NO: 16339
  derived and/or modified CDS sequence (AUadapt) from InfluenzaA__AFN19691__NA

SEQ ID NO: 25467 - RNA, 1410 nt, Artificial Sequence
  derived and/or modified CDS sequence (AUadapt) from InfluenzaA__AFN19693__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggacauccugcgcacccaggagucggagugcgugugcaucaacggcacgugcgccguggucaugaccgacggguccgccagcggcaaggcggacaccaagauccucuucaucgaggagggcaagaucgugcacaccucgacgcuguccgggucggcccagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcuccaacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggaccggggcaaccgcuccggguacucgggcaucuucuccgucgaggggaagaacugcaucaaccggugcuucuacguggagcucauccgcggccggaaggaggagaccgaggugcuguggaccagcaacucgaucgucguguucugcggcaccuccgggacguacggcaccgggagcuggccggacggcgccgaccugaaccucaugcccaucuga

SEQ ID NO: 25468 - RNA, 1410 nt, Artificial Sequence
  derived and/or modified CDS sequence (AUadapt) from InfluenzaA__AFN19697__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggagacccugcgcacgcaggagagcgagugcgugugcaucaacgggaccugcaccguggucaugaccgacggcuccgccucgggcaaggccgacacgaagauccuguucaucgaggaggggaagaucgugcacaccagcacccucuccggcucggcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacaccccgcggaagaacgacuccagcuccucgucccacugccuggaccccaacaacgaggagggcgggcacggcgucaaggggugggccuucgacgacggcaacgacguguggaugggccgcacgaucaacgagaccucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggacgucgaacuccaucgucguguucugcgggaccagcggcaccuacgggaccggcuccuggcccgacggggccgaccugaaccugaugcccaucuga

SEQ ID NO: 25469 - RNA, 1410 nt, Artificial Sequence; identical to SEQ ID NO: 25324
  derived and/or modified CDS sequence (AUadapt) from InfluenzaA__AFN19699__NA

SEQ ID NO: 25470 - RNA, 1410 nt, Artificial Sequence; identical to SEQ ID NO: 25360
  derived and/or modified CDS sequence (AUadapt) from InfluenzaA__AFN19701__NA

SEQ ID NO: 25471 - RNA, 1410 nt, Artificial Sequence
  derived and/or modified CDS sequence (AUadapt) from InfluenzaA__AFN19703__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucgacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 25472 - RNA, 1410 nt, Artificial Sequence; identical to SEQ ID NO: 22659
  derived and/or modified CDS sequence (AUadapt) from InfluenzaA__AFN19711__NA

SEQ ID NO: 25473 - RNA, 1410 nt, Artificial Sequence
  derived and/or modified CDS sequence (AUadapt) from InfluenzaA__AFN19721__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagccccauggagugccgcaccuucuuccugacccagggcgcccugcucaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcugaccaucggcaucagcggccccgacaacggggccguggccguccucaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccuggaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggucgggcuacuccgggagcuucgugcagcacccggagcucacgggccuggacugcauccgccccugcuucuggguggagcugauccggggccgccccaaggagaacaccaucuggaccuccgggagcuccaucagcuucugcggcgucaacuccgacaccgugggguggagcuggcccgacggcgccgagcucccguucacgaucgacaaguga

SEQ ID NO: 25474 - RNA, 1410 nt, Artificial Sequence; identical to SEQ ID NO: 23480
  derived and/or modified CDS sequence (AUadapt) from InfluenzaA__AFN19731__NA

SEQ ID NO: 25475 - RNA, 1410 nt, Artificial Sequence; identical to SEQ ID NO: 22659
  derived and/or modified CDS sequence (AUadapt) from InfluenzaA__AFN19737__NA

SEQ ID NO: 25476 - RNA, 1410 nt, Artificial Sequence
  derived and/or modified CDS sequence (AUadapt) from InfluenzaA__AFN19747__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucacccacgagaacaacaccugggugaaccagaccuacgugaacaucuccaacacgaacuucgccgcgggccagucggucguguccgugaagcuggccgggaacagcucccucugcccggucagcggcugggccaucuacuccaaggacaacagcauccgcaucggcuccaagggggacguguucgugauccgggagcccuucaucucgugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacucgcgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccucggagaucacgugcgugugccgggacaacuggcacggcgccaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucucgagccggaacggcuucgagaugaucugggaccccaacggguggaccggcaccgacaacaacuucuccaucaagcaggacaucguggggaucaacgaguggagcggcuacuccgggucguucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgcggagcugccguucacgaucgacaaguga

SEQ ID NO: 25477 - RNA, 1410 nt, Artificial Sequence; identical to SEQ ID NO: 22659
  derived and/or modified CDS sequence (AUadapt) from InfluenzaA__AFN19749__NA

SEQ ID NO: 25478 - RNA, 1410 nt, Artificial Sequence; identical to SEQ ID NO: 22659
  derived and/or modified CDS sequence (AUadapt) from InfluenzaA__AFN19759__NA

SEQ ID NO: 25479 - RNA, 1410 nt, Artificial Sequence
  derived and/or modified CDS sequence (AUadapt) from InfluenzaA__AFN19769__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaaccgcgccguggccguccugaaguacaacgggaucaucaccgacaccaucaaguccuggcggaacaacauccugcgcacgcaggagucggagugcgcgugcgugaacggcuccugcuucaccaucaugaccgacgggccgagcgacggccaggccuccuacaagaucuuccggaucgagaagggcaagaucgucaagagcguggagaugaacgcccccaacuaccacuacgaggagugcuccugcuaccccgacagcuccgagaucacgugcgugugccgcgacaacuggcacgggagcaaccggcccuggguguccuucaaccagaaccucgaguaccagaucggcuacaucugcucggggaucuucggcgacaacccgcgccccaacgacaagaccggguccugcggccccgucagcuccaacggcgccaacggggugaagggcuucagcuucaaguacgggaacggcguguggaucgggcggaccaagagcaucuccagccgcaagggcuucgagaugaucugggaccccaacggcuggaccgggaccgacaacaacuucuccaucaagcaggacaucgucggcaucaacgaguggucgggguacuccggcagcuucgugcagcacccggagcugacggggcuggacugcauccggcccugcuucuggguggagcucauccgcggccggcccaaggagaacaccaucuggaccuccggcagcuccaucagcuucugcggggucaacuccgacaccgugggcuggagcuggcccgacggggccgagcugccguucacgaucgacaaguga

SEQ ID NO: 25480 - RNA, 1410 nt, Artificial Sequence; identical to SEQ ID NO: 22659
  derived and/or modified CDS sequence (AUadapt) from InfluenzaA__AFN19783__NA

SEQ ID NO: 25481 - RNA, 1410 nt, Artificial Sequence; identical to SEQ ID NO: 23360
  derived and/or modified CDS sequence (AUadapt) from InfluenzaA__AFN19793__NA

SEQ ID NO: 25482 - RNA, 1410 nt, Artificial Sequence; identical to SEQ ID NO: 22659
  derived and/or modified CDS sequence (AUadapt) from InfluenzaA__AFN19807__NA

SEQ ID NO: 25483 - RNA, 1410 nt, Artificial Sequence
  derived and/or modified CDS sequence (AUadapt) from InfluenzaA__AFN19809__NA
augaaccccaaccagaagaucaucaccaucggcucggugugcaugaucaucgggauggccaaccugaugcuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucaucuccgugaagcuggccgggaacucgucccucugcccggugagcggcugggccaucuacuccaaggacaacagcauccgcaucggcuccaagggggacgucuucgugauccgggagcccuucaucagcugcagcccccuggagugccgcacguucuuccugacccagggcgcccuccugaacgacaagcacuccaacgggaccaucaaggaccggucccccuaccgcacccugaugucgugcccgaucggcgaggugcccucccccuacaacagccgguucgagagcgucgccugguccgcgagcgccugccacgacgggaucaacuggcucacgaucggcaucuccggccccgacaacggggccguggccgugcugaaguacaacggcaucaucaccgacaccaucaagagcuggcgcaacaacauccugcggacccaggaguccgagugcgcgugcgucaacgggucgugcuucacggugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccaccaacggggccaacggcgugaagggguucagcuucaaguacggcaacgggguguggaucggccgcaccaaguccaucagcagccggaacggcuucgagaugaucugggaccccaacggguggaccggcaccgacaacaaguucuccaucaagcaggacaucgucgggaucaacgaguggucgggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 25484 - RNA, 1410 nt, Artificial Sequence; identical to SEQ ID NO: 23482
  derived and/or modified CDS sequence (AUadapt) from InfluenzaA__AFN19815__NA

SEQ ID NO: 25485 - RNA, 1410 nt, Artificial Sequence
  derived and/or modified CDS sequence (AUadapt) from InfluenzaA__AFN19833__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggaagaacaacauccugcgcacgcaggagucggagugcgcgugcgugaacggguccugcuucaccaucaugaccgacggcccgagcgacggccaggccuccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcagcaaccggcccuggguguccuucaaccagaaccucgaguaccagaucggguacaucugcucgggcaucuucggggacaacccgcgccccaacgacaagaccggcuccugcggccccgucagcuccaacggggccaacggcgugaagggguucagcuucaaguacggcaacgggguguggaucggccggaccaagagcaucuccagccgcaagggcuucgagaugaucugggaccccaacggguggaccggcaccgacaacaacuucuccaucaagcaggacaucgucgggaucaacgaguggucgggcuacuccgggagcuucgugcagcacccggagcugacgggccuggacugcauccggcccugcuucuggguggagcucauccgcggccggcccaaggagaacaccaucuggaccuccgggagcuccaucagcuucugcggcgucaacuccgacaccgugggguggagcuggcccgacggcgccgagcugccguucacgaucgacaaguga

SEQ ID NO: 25486 - RNA, 1410 nt, Artificial Sequence; identical to SEQ ID NO: 23118
  derived and/or modified CDS sequence (AUadapt) from InfluenzaA__AFN19851__NA

SEQ ID NO: 25487 - RNA, 1410 nt, Artificial Sequence; identical to SEQ ID NO: 22659
  derived and/or modified CDS sequence (AUadapt) from InfluenzaA__AFN19857__NA

SEQ ID NO: 25488 - RNA, 1410 nt, Artificial Sequence
  derived and/or modified CDS sequence (AUadapt) from InfluenzaA__AFN19867__NA
augaaccccaaccagaagaucaucaccaucggcucggugugcaugaccaucgggauggccaaccugauccuccagaucggcaacaucaucuccaucuggaucagccacuccauccagaucgggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccugugcccggucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggucgugcuucaccaucaucaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccuggaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucucgaucaagcaggacaucgucgggaucaacgagugguccggcuacagcggguccuucgugcagcacccggagcucacgggccuggacugcauccgccccugcuucuggguggagcugauccggggccgccccaaggagaacaccaucuggaccagcggguccagcaucuccuucugcggcgucaacagcgacaccguggggugguccuggcccgacggcgccgagcucccguucacgaucgacaaguga

SEQ ID NO: 25489 - RNA, 1410 nt, Artificial Sequence; identical to SEQ ID NO: 23111
  derived and/or modified CDS sequence (AUadapt) from InfluenzaA__AFN19877__NA

SEQ ID NO: 25490 - RNA, 1410 nt, Artificial Sequence; identical to SEQ ID NO: 22659
  derived and/or modified CDS sequence (AUadapt) from InfluenzaA__AFN19887__NA

SEQ ID NO: 25491 - RNA, 1410 nt, Artificial Sequence
  derived and/or modified CDS sequence (AUadapt) from InfluenzaA__AFN19897__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccugcaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggucgggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 25492 - RNA, 1410 nt, Artificial Sequence; identical to SEQ ID NO: 22659
  derived and/or modified CDS sequence (AUadapt) from InfluenzaA__AFN19907__NA

SEQ ID NO: 25493 - RNA, 1410 nt, Artificial Sequence; identical to SEQ ID NO: 23118
  derived and/or modified CDS sequence (AUadapt) from InfluenzaA__AFN19917__NA

SEQ ID NO: 25494 - RNA, 1410 nt, Artificial Sequence
  derived and/or modified CDS sequence (AUadapt) from InfluenzaA__AFN19923__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccagaacgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 25495 - RNA, 1410 nt, Artificial Sequence; identical to SEQ ID NO: 22659
  derived and/or modified CDS sequence (AUadapt) from InfluenzaA__AFN19933__NA

SEQ ID NO: 25496 - RNA, 1410 nt, Artificial Sequence; identical to SEQ ID NO: 23118
  derived and/or modified CDS sequence (AUadapt) from InfluenzaA__AFN19943__NA

SEQ ID NO: 25497 - RNA, 1410 nt, Artificial Sequence
  derived and/or modified CDS sequence (AUadapt) from InfluenzaA__AFN19953__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccagcgcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccggaucggcuccaagggggacguguucgugauccgcgagcccuucaucagcugcagcccccuggagugccggaccuucuuccugacccagggcgcccuccugaacgacaagcacuccaacgggaccaucaaggaccgcucccccuaccggacgcugaugucgugcccgaucggcgagguccccucccccuacaacagccgcuucgagagcguggccugguccgcgagcgccugccacgacgggaucaacuggcucaccaucggcaucuccggccccgacaacggggccguggccguccugaaguacaacggcaucaucaccgacaccaucaagagcuggcggaacaacauccugcgcacgcaggaguccgagugcgcgugcgugaacgggucgugcuucaccaucaugaccgacggcccguccgacggccaggccagcuacaagaucuuccggaucgagaaggggaagaucgugaaguccgucgagaugaacgcccccaacuaccacuacgaggagugcagcugcuaccccgacuccagcgagaucacgugcgugugccgcgacaacuggcacggcuccaaccggcccugggugucguucaaccagaaccucgaguaccagaucggguacaucugcuccggcaucuucggggacaacccgcgccccaacgacaagaccggcagcugcggccccgucuccagcaacggggccaacggcgugaagggguucuccuucaaguacggcaacgggguguggaucggccggaccaagagcaucagcucccgcaagggcuucgagaugaucugggaccccaacggguggaccggcaccgacaacaacuucucgaucaagcaggacaucgucgagaucaacgagugguccggguacagcggcuccuucgugcagcacccggagcugacggggcuggacugcauccggcccugcuucuggguggagcucauccgcggccggcccaaggagaacaccaucuggaccagcggcuccagcaucuccuucugcggggucaacagcgacaccgugggcugguccuggcccgacggggccgagcugccguucacgaucgacaaguga

SEQ ID NO: 25498 - RNA, 1410 nt, Artificial Sequence
  derived and/or modified CDS sequence (AUadapt) from InfluenzaA__AFN19967__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucgcgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcagcaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucagcuucaaguacggcaacgggguguggaucggccgcaccaaguccaucucgucccggaagggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 25499 - RNA, 1410 nt, Artificial Sequence
  derived and/or modified CDS sequence (AUadapt) from InfluenzaA__AFN19973__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucgcgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcagcuccgacggccaggccagcuacaagaucuuccgcaucgagaaggggaagaucgugaaguccgucgagaugaacgccccgaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccccggccgaacgacaagaccggcagcugcggccccgucuccagcaacggggccaacggcgugaagggguucagcuucaaguacggcaacgggguguggaucggccgcaccaaguccaucucgucccggaagggcuucgagaugaucugggaccccaacggguggaccggcaccgacaacaacuucagcaucaagcaggacaucgucgggaucaacgagugguccggcuacagcggguccuucgugcagcaccccgagcugacgggccuggacugcauccgcccgugcuucuggguggagcucauccggggccgccccaaggagaacaccaucuggaccagcggguccagcaucuccuucugcggcgucaacagcgacaccguggggugguccuggcccgacggcgccgagcugcccuucacgaucgacaaguga

SEQ ID NO: 25500 - RNA, 1410 nt, Artificial Sequence; identical to SEQ ID NO: 22659
  derived and/or modified CDS sequence (AUadapt) from InfluenzaA__AFN19979__NA

SEQ ID NO: 25501 - RNA, 1410 nt, Artificial Sequence
  derived and/or modified CDS sequence (AUadapt) from InfluenzaA__AFN19985__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaagagcgucuccagccggaagggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 25502 - RNA, 1410 nt, Artificial Sequence
  derived and/or modified CDS sequence (AUadapt) from InfluenzaA__AFN19995__NA
augaaccccaaccagaagaucaucaccaucggcucggugugcaugaccaucgggauggccaaccugauccuccagaucggcaacaucaucuccaucuggaucagccacuccauccagcuggggaaccagagccagacggagaccugcaaccaguccgucaucaccuacgagaacaacaccugggugaaccagacguacgugaacaucagcaacaccaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcucgccccuggagugccgcaccuucuuccugacccagggcgcccuccugaacgacaagcacuccaacgggacgaucaaggaccggagccccuaccgcacccugauguccugcccgaucggcgagguccccagccccuacaacagccgguucgaguccguggccuggucggcguccgccugccacgacgggaucaacuggcucaccaucggcaucagcggccccgacaacggggccguggccguccugaaguacaacggcaucaucaccgacacgaucaaguccuggcgcaacaacauccugcggacccaggagagcgagugcgcgugcgugaacggguccugcuucaccaucaugaccgacggcccgagcgacggccaggccuccuacaagaucuuccgcaucgagaaggggaagaucgucaagucgguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucucguccaacggggccaacggcgugaagggguucagcuucaaguacggcaacgggguguggaucggccgcaccaagagcaucuccagccggaagggcuucgagaugaucugggaccccaacggguggaccggcacggacaacaacuucuccaucaagcaggacaucgucgggaucaacgaguggucgggcuacuccgggagcuucgugcagcacccggagcugaccggccuggacugcauccgccccugcuucuggguggagcucauccggggccgccccaaggagaacaccaucuggaccuccgggagcuccaucagcuucugcggcgucaacuccgacacggugggguggagcuggcccgacggcgccgagcugccguucaccaucgacaaguga

SEQ ID NO: 25503 - RNA, 1410 nt, Artificial Sequence; identical to SEQ ID NO: 22659
  derived and/or modified CDS sequence (AUadapt) from InfluenzaA__AFN20001__NA

SEQ ID NO: 25504 - RNA, 1410 nt, Artificial Sequence
  derived and/or modified CDS sequence (AUadapt) from InfluenzaA__AFN20013__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcgaccccgucagcuccaacggcgccaacggggugaagggcuucagcuucaaguacgggaacggcguguggaucgggcgcaccaagagcaucuccagccggaagggcuucgagaugaucugggaccccaacggcuggaccgggaccgacaacaacuucuccaucaagcaggacaucgucggcaucaacgaguggucgggguacuccggcagcuucgugcagcacccggagcugacggggcuggacugcauccgccccugcuucuggguggagcucauccggggccgccccaaggagaacaccaucuggaccuccggcagcuccaucagcuucugcggggucaacuccgacaccgugggcuggagcuggcccgacggggccgagcugccguucacgaucgacaaguga

SEQ ID NO: 25505 - RNA, 1410 nt, Artificial Sequence
  derived and/or modified CDS sequence (AUadapt) from InfluenzaA__AFN20020__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggcugaacgaguggucgggcuacuccgggagcuucgugcagcacccggagcugacgggccucgacugcauccgccccugcuucuggguggagcugauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 25506 - RNA, 1410 nt, Artificial Sequence; identical to SEQ ID NO: 22659
  derived and/or modified CDS sequence (AUadapt) from InfluenzaA__AFN20022__NA

SEQ ID NO: 25507 - RNA, 1410 nt, Artificial Sequence
  derived and/or modified CDS sequence (AUadapt) from InfluenzaA__AFN20035__NA
augaaccccaaccagaagaucaucaccaucggcucggugugcaugaccaucgggaucgccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggucgggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 25508 - RNA, 1410 nt, Artificial Sequence; identical to SEQ ID NO: 22659
  derived and/or modified CDS sequence (AUadapt) from InfluenzaA__AFN20041__NA

SEQ ID NO: 25509 - RNA, 1410 nt, Artificial Sequence; identical to SEQ ID NO: 22659
  derived and/or modified CDS sequence (AUadapt) from InfluenzaA__AFN20047__NA

SEQ ID NO: 25510 - RNA, 1410 nt, Artificial Sequence; identical to SEQ ID NO: 23482
  derived and/or modified CDS sequence (AUadapt) from InfluenzaA__AFN20063__NA

SEQ ID NO: 25511 - RNA, 1410 nt, Artificial Sequence
  derived and/or modified CDS sequence (AUadapt) from InfluenzaA__AFN20077__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuucaagaucgagaaggggaagaucgucaagagcguggagaugaacgcccccaacuaccacuacgaggagugcuccugcuaccccgacagcuccgagaucacgugcgugugccgcgacaacuggcacggcagcaaccggcccuggguguccuucaaccagaaccucgaguaccagaucggguacaucugcucgggcaucuucggggacaacccgcgccccaacgacaagaccggcuccugcggccccgucagcuccaacggggccaacggcgugaagggguucagcuucaaguacggcaacgggguguggaucggccggaccaagagcaucuccagccgcaagggcuucgagaugaucugggaccccaacggguggaccggcaccgacaacaacuucuccaucaagcaggacaucgucgggaucaacgaguggucgggcuacuccgggagcuucgugcagcacccggagcugacgggccuggacugcauccggcccugcuucuggguggagcucauccgcggccggcccaaggagaacaccaucuggaccuccgggagcuccaucagcuucugcggcgucaacuccgacaccgugggguggagcuggcccgacggcgccgagcugccguucacgaucgacaaguga

SEQ ID NO: 25512 - RNA, 1410 nt, Artificial Sequence; identical to SEQ ID NO: 22659
  derived and/or modified CDS sequence (AUadapt) from InfluenzaA__AFN20083__NA

SEQ ID NO: 25513 - RNA, 1410 nt, Artificial Sequence
  derived and/or modified CDS sequence (AUadapt) from InfluenzaA__AFN20094__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaucuacgagaacaacaccugggugaaccagaccuacgugaacaucagcaacaccaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcacguucuuccugacccagggcgcccuccugaacgacaagcacuccaacgggaccaucaaggaccggagccccuaccgcacccugauguccugcccgaucggcgagguccccagccccuacaacucgcgguucgaguccguggccuggagcgcguccgccugccacgacgggaucaacuggcucacgaucggcaucagcggccccgacaacggggccguggccguccugaaguacaacggcaucaucaccgacaccaucaaguccuggcgcaacaacauccugcggacccaggagagcgagugcgcgugcgugaacggguccugcuucacgaucaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccuggguguccuucaaccagaaccucgaguaccagaucggguacaucugcagcggcaucuucggggacaacccgcggcccaacgacaaggccggcuccugcggccccgucagcuccaacggggccaacggcgugaagggguucagcuucaaguacggcaacgggguguggaucggccgcaccaagagcaucuccucgcggaagggcuucgagaugaucugggaccccaacggguggaccggcaccgacaacaacuucuccaucaagcaggacaucgucgggaucaacgaguggagcggcuacuccgggagcuucgugcagcacccggagcugaccggccuggacugcauccgccccugcuucuggguggagcucauccggggccgccccaaggagaacaccaucuggacguccgggagcuccaucagcuucugcggcgucaacuccgacaccaugggguggagcuggcccgacggcgcggagcugccguucaccaucgacaaguga

SEQ ID NO: 25514 - RNA, 1410 nt, Artificial Sequence; identical to SEQ ID NO: 23118
  derived and/or modified CDS sequence (AUadapt) from InfluenzaA__AFN20100__NA

SEQ ID NO: 25515 - RNA, 1410 nt, Artificial Sequence
  derived and/or modified CDS sequence (AUadapt) from InfluenzaA__AFN20114__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuucaagaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcucgugcucccccgugagcuccaacggcgccaacggggugaagggcuucagcuucaaguacgggaacggcgucuggaucgggcggaccaagagcaccuccagccgcaacggcuucgagaugaucugggaccccaacggcuggaccgggacggacaacuccuucucgaugaagcaggacaucgugggcaucaacgagugguccggguacagcggcuccuucgugcagcacccggagcugaccgggcuggacugcauccggcccugcuucugggucgagcucauccgcggccggcccaaggagaacaccguguggaccagcggcuccagcaucuccuucugcggggucaacagcgacacggugggcugguccuggcccgacggggccgagcugccguucaccaucgacaaguga

SEQ ID NO: 25516 - RNA, 1410 nt, Artificial Sequence
  derived and/or modified CDS sequence (AUadapt) from InfluenzaA__AFN20128__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucgcgguucgaguccguggccuggagcgcguccgccugccacgacgggaucaacuggcucaccaucggcaucagcggccccgacaacggggccguggccguccugaaguacaacggcaucaucaccgacaccauccgcuccuggcggaacaacauccugcgcacgcaggagagcgagugcgcgugcgugaacggguccugcuucaccaucaugaccgacggcccgagcgacggccaggccuccuacaagaucuuccggaucgagaaggggaagaucaucaagagcguggagaugaacgcccccaacuaccacuacgaggagugcuccugcuaccccgacucguccgagaucacgugcgucugccgcgacaacuggcacggcagcaaccggcccuggguguccuucaaccagaaccucgaguaccagaucggguacaucugcagcggcaucuucggggacaacccgcgcuccaacgacaagaccggcagcugcggccccguguccagcaacggggccaacggcgucaagggguucagcuucaaguacggcaacgggguguggaucggccggaccaaguccaucucgucccgcaagggcuucgagaugaucugggaccccaacggguggaccggcaccgacaacaacuucagcaucaagcaggacaucguggggaucaacgagugguccggcuacagcggguccuucguccagcaccccgagcugacgggccuggacugcauccggccgugcuucuggguggagcucauccgcggccggcccaaggagaacaccaucuggaccagcggguccagcaucuccuucugcggcgugaacagcgacaccgucgggugguccuggcccgacggcgccgagcugcccuucacgaucgacaaguga

SEQ ID NO: 25517 - RNA, 1410 nt, Artificial Sequence; identical to SEQ ID NO: 22659
  derived and/or modified CDS sequence (AUadapt) from InfluenzaA__AFN87935__NA

SEQ ID NO: 25518 - RNA, 1410 nt, Artificial Sequence
  derived and/or modified CDS sequence (AUadapt) from InfluenzaA__AFN87937__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuucaagaucgagaaggggaagaucgucaaguccguggagaugaacgcccccaacuaccacuacgaggagugcucgugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccucgaacggggccaacggcgugaagggguucuccuucaaguacggcaacggggucuggaucggccggaccaagagcaccagcucccgcaacggcuucgagaugaucugggaccccaacggguggaccggcacggacaacagcuucuccaugaagcaggacaucguggggaucaacgaguggucgggcuacuccgggagcuucgugcagcacccggagcugaccggccuggacugcauccggcccugcuucugggucgagcucauccgcggccggcccaaggagaacaccguguggaccuccgggagcuccaucagcuucugcggcgucaacuccgacacggugggguggagcuggcccgacggcgccgagcugccguucaccaucgacaaguga

SEQ ID NO: 25519 - RNA, 1410 nt, Artificial Sequence
  derived and/or modified CDS sequence (AUadapt) from InfluenzaA__AFN87940__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuucaagaucgagaaggggaagaucgucaaguccguggagaugaacgcccccaacuaccacuacgaggagugcucgugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccucgaacggggccaacggcgugaagggguucuccuucaaguacggcaacggggucuggaucggccggaccaagagcaccagcucccgcaacggcuucgagaugaucugggaccccaacggguggaccggcacggacaacagcuucuccaucaagcaggacaucguggggaucaacgaguggucgggcuacuccgggagcuucgugcagcacccggagcugaccggccuggacugcauccggcccugcuucugggucgagcucauccgcggccggcccaaggagaacaccaucuggaccuccgggagcuccaucagcuucugcggcgugaacuccgacacggucggguggagcuggcccgacggcgccgagcugccguucaccaucgacaaguga

SEQ ID NO: 25520 - RNA, 1410 nt, Artificial Sequence; identical to SEQ ID NO: 16318
  derived and/or modified CDS sequence (AUadapt) from InfluenzaA__AFN87942__NA

SEQ ID NO: 25521 - RNA, 1410 nt, Artificial Sequence; identical to SEQ ID NO: 25518
  derived and/or modified CDS sequence (AUadapt) from InfluenzaA__AFN87944__NA

SEQ ID NO: 25522 - RNA, 1410 nt, Artificial Sequence
  derived and/or modified CDS sequence (AUadapt) from InfluenzaA__AFN87946__NA
augaaccccaaccagaagaucaucaccaucggcucggugugcaugaccaucgggauggccaaccugacgcuccagaucggcaacaucaucuccaucuggaucagccacuccauccagcuggggaaccagaaccagaucgagaccugcaaccagagcgucaucaacuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucgucagcugcucgccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgucggccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcucgugcuaccccgacuccagcgaggugaccugcgucugccgggacaacuggcacggcuccaaccgccccugggugagcuucaaccagaaccucgaguaccagaucggguacaucugcuccggcaucuucggggacaacccgcggcccaacgacaagacgggcagcugcggccccgucuccucgaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacucgggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccguggggugguccuggcccgacggcgccgagcugccguucacgaucgacaaguga

SEQ ID NO: 25523 - RNA, 1410 nt, Artificial Sequence
  derived and/or modified CDS sequence (AUadapt) from InfluenzaA__AFN87948__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuucaagaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcucgugcggccccguguccagcaacggggccaacggcgugaagggguucuccuucaaguacggcaacggggucuggaucggccggaccaagagcaccagcucccgcaacggcuucgagaugaucugggaccccaacggguggaccggcacggacaacagcuucuccaucaagcaggacaucguggggaucaacgaguggucgggcuacuccgggagcuucgugcagcacccggagcugaccggccuggacugcauccggcccugcuucugggucgagcucauccgcggccggcccaaggagaacaccaucuggaccuccgggagcuccaucagcuucugcggcgugaacuccgacaucgucggguggagcuggcccgacggcgccgagcugccguucacgaucgacaaguga

SEQ ID NO: 25524 - RNA, 1410 nt, Artificial Sequence
  derived and/or modified CDS sequence (AUadapt) from InfluenzaA__AFN87950__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucaaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaagggcuucgagaugaucugggaccccaacggguggaccggcaccgacaacaacuucuccaucaagcaggacaucaucgggaucaacgaguggucgggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 25525 - RNA, 1410 nt, Artificial Sequence; identical to SEQ ID NO: 23111
  derived and/or modified CDS sequence (AUadapt) from InfluenzaA__AFN87952__NA

SEQ ID NO: 25526 - RNA, 1410 nt, Artificial Sequence
  derived and/or modified CDS sequence (AUadapt) from InfluenzaA__AFN87954__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaagggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccauggggugguccuggcccgacggcgccgagcugccguucacgaucgacaaguga

SEQ ID NO: 25527 - RNA, 1410 nt, Artificial Sequence
  derived and/or modified CDS sequence (AUadapt) from InfluenzaA__AFN87956__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggucgggaacuccagccucugcccgguguccggcugggccaucuacagcaaggacaacuccauccgcaucggcagcaagggggacguguucgucauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgaggugcccagccccuacaacagccgguucgaguccguggccuggagcgccuccgcgugccacgacgggaucaacuggcucaccaucggcaucagcggccccgacaacggggccgucgccgugcugaaguacaacggcaucaucaccgacaccaucaaguccuggcgcaacaacauccugcggacgcaggagucggagugcgccugcgugaacggguccugcuucaccaucaugaccgacggcccgagcgacggccaggcguccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaagggcuucgagaugaucugggaccccaacggguggaccggcaccgacaacaacuucuccaucaagcaggacaucguggggacgaacgaguggucgggcuacuccgggagcuucgugcagcacccggagcugaccggccuggacugcauccgccccugcuucugggucgagcucauccggggccgccccaaggagaacaccaucuggaccuccgggagcuccaucagcuucugcggcgugaacuccgacacggucggguggagcuggcccgacggcgccgagcugccguucaccaucgacaacuga

SEQ ID NO: 25528 - RNA, 1410 nt, Artificial Sequence
  derived and/or modified CDS sequence (AUadapt) from InfluenzaA__AFN87958__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagucggucguguccgugaagcuggccgggaacagcucccucugcccggucagcggcugggccaucuacuccaaggacaacagcauccgcaucggcuccaagggggacguguucgugauccgggagcccuucaucucgugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacucgcgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuucaagaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucucguucaaccagaaccucgaguaccagaucggguacaucugcuccggcaucuucggggacaacccgcgccccaacgacaagaccggcagcugcggccccgccuccagcaacggggccaacggcgugaagggguucuccuucaaguacggcaacgggguguggaucggccggaccaagucgaccagcucccgcaacggcuucgagaugaucugggaccccaacggguggaccggcacggacaacagcuucuccaugaagcaggacaucgucgggaucaacgaguggagcggcuacuccgggucguucgugcagcacccggagcugaccggccuggacugcauccggcccugcuucuggguggagcucauccgcggccggcccaaggagaacaccgucuggaccuccgggagcuccaucagcuucugcggcgugaacuccgacacggucggguggagcuggcccgacggcgcggagcugccguucaccaucgacaaguga

SEQ ID NO: 25529 - RNA, 1410 nt, Artificial Sequence
  derived and/or modified CDS sequence (AUadapt) from InfluenzaA__AFN87960__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggucgggcuacuccgggagcuucgugcagcacccggagcugacgggccuggacugcauccgccccugcuucuggaucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 25530 - RNA, 1413 nt, Artificial Sequence
  derived and/or modified CDS sequence (AUadapt) from InfluenzaA__AFO64805__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucucgggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggucggccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccaacaacggcgccgccagcuacaagaucuucaagaucgagaaggggaaggucaccaaguccaucgagcucaacgcccccaacucgcacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcgagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacucggacuucuccgucaagcaggacgugguggccaucacggacuggagcggguacucgggcuccuucguccagcaccccgagcucaccggccuggacugcauccgccccugcuucuggguggagcugguccgggggcucccgcgcgagaacaccaccaucuggacgagcggcuccucgaucuccuucugcggggugaacagcgacaccgccaacugguccuggcccgacggcgccgagcugcccuucaccaucgacaaguga

SEQ ID NO: 25531 - RNA, 1413 nt, Artificial Sequence
  derived and/or modified CDS sequence (AUadapt) from InfluenzaA__AFO64816__NA
augaaccccaaccagaagaucaucaccaucggcucgaucugcauggccaucgggaucaucucccugauccuccagaucggcaacaucgugagcaucuggaucucccacucgauccagaccgggucccagaacuacacgggcaucugcaaccagcgcaucaucaccuacgagaacagcaccugggucaaccagaccuacgugaacaucaacaacacgaacguggucgccgggcaggacaccaccuccguggcgcuggccggcaacucgucccugugcccgaucagcggcugggccaucuacuccaaggacaacucgauccggaucggguccaagggcgacguguucgucauccgcgagcccuucaucagcugcucccaccucgagugccggaccuucuuccugacgcagggggcccugcucaacgacaagcacucgaacggcaccgugaaggaccgcucccccuaccgggcccugaugagcugccccaucggggaggcgccgucccccuacaacucgcgcuucgagagcguggccugguccgccagcgccugccacgacggcaugggcuggcugaccaucgggaucuccggccccgacgacggggcggucgccgugcucaaguacaacggcaucaucaccgagacgaucaagucguggcggcgccggauccugcgcacccaggaguccgagugcgugugcgucaacggcagcugcuucaccaucaugaccgacgggcccaacaacggcccggccuccuacaagaucuucaagaucgagaaggggaaggugaccaagucgaucgagcuggacgcccccaacucccacuacgaggagugcagcugcuaccccgacgccggcacggugaugugcgucugccgggacaacuggcacggguccaaccgccccugggugucguucaaccagaaccucgacuaccagaucggcuacaucugcuccggcguguucggggacaacccgcggcccaaggacggcaaggggagcugcgaccccgucaccguggacggcgcggacggggugaagggcuucuccuaccgcuacggcaacggggucuggaucggccggaccaagucgaacuccagccgccggggguucgagaugaucugggaccccaacggcuggacggacaccgacuccaaguuccuggugaagcaggacguggucgccaugaccgacuggucgggguacagcggcuccuucgugcagcacccggagcugaccggccucgacugcaugcgccccugcuucugggucgagcugauccgggggcgcccccgggagaacacgaccaucuggaccucgggcuccagcaucuccuucugcggggugaacggcgacaccgccaacuggagcuggcccgacggcgccgagcugccguucacgaucgacaaguga

SEQ ID NO: 25532 - RNA, 1413 nt, Artificial Sequence
  derived and/or modified CDS sequence (AUadapt) from InfluenzaA__AFO64827__NA
augaaccccaaccagaagaucaucaccaucggcucgaucuccauggccaucgggaucaucagccugauccuccagaucggcaacaucaucuccaucugggugucgcacuccauccagaccgggagccagaaccacacgggcaucugcaaccagcgcaucaucaccuacgagaacuccaccugggucaaccagaccuacgugaacaucaacaacacgaacgugaucgccgggaaggacaagaccucggucacccuggcgggcaacuccagccugugcccgauccggggcugggccaucuacaccaaggacaacuccauccgcaucgggucgaagggcgacguguucgugauccgggagcccuucaucuccugcagccaccucgagugccgcacguucuuccugacccagggggcccugcucaacgacaagcacuccaacggcaccgucaaggaccggucgcccuaccgcgcccugauguccugcccccugggggaggccccgagccccuacaacucccgguucgagucgguggcguggagcgccuccgccugccacgacggcaugggcuggcucaccaucgggaucucgggccccgacgacggggccguggcgguccugaaguacaacggcaucaucacggagaccaucaaguccuggaagaagcgcauccugcggacccaggagagcgagugcgugugcgugaacggcuccugcuucaccaucaugacggacgggcccucgaacggcgccgccuccuaccgcaucuucaagaucgagaaggggaaggucaccaagagcaucgagcucgacgccccgaacucccacuacgaggagugcucgugcuaccccgacaccggcaccgugaugugcgugugccgggacaacuggcacggguccaaccgccccugggucagcuucaaccagaaccuggacuaccagaucggcuacaucugcuccggcguguucggggacaacccccggccgaaggacggcaaggggucgugcgaccccgugacggucgacggcgccgacggggugaagggcuucuccuaccgcuacggcaacgggguguggaucggccggaccaagagcaaccgcuuccggaagggguucgagaugaucugggaccccaacggcuggaccgacaccgacuccgacuuccuggucaagcaggacgugguggcgaugacggacuggucgggguacuccggcagcuucguccagcaccccgagcucaccggccuggacugcaugcgcccgugcuucuggguggagcugguccgggggcgcccccgggagaacaccaccaucuggacgucgggcuccagcaucuccuucugcggggugaacagcgacaccgccaacugguccuggcccgacggcgccgagcuccccuucaccaucgacaaguga

SEQ ID NO: 25533 - RNA, 1413 nt, Artificial Sequence
  derived and/or modified CDS sequence (AUadapt) from InfluenzaA__AFO64838__NA
augaaccccaaccagaagaucaucaccaucggcucgaucuccauggccaucgggaucaucucgcugauccuccagaucggcaacaucaucuccaucugggccagccacuccauccagaccgggucgcagaaccacacgggcaucugcaaccagcgcaucaucaccuacgagaacuccaccugggugaaccagaccuacgucaacaucaacaacacgaacgugguggcggggaaggacaagaccagcgucacccuggccggcaacuccucgcugugcccgauccggggcugggccaucuacaccaaggacaacuccauccgcaucgggagcaagggcgacguguucgugauccgggagcccuucaucuccugcucgcaccucgagugccgcacguucuuccugacccagggggcccugcucaacgacaagcacuccaacggcaccgucaaggaccggagccccuaccgcgcccugauguccugcccccugggggaggcgccgucgcccuacaacucccgguucgagagcguggccuggucggccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuaccgcaucuucaagaucgagaaggggcgggucaccaagucgaucgagcucgacgccccgaacuaccacuacgaggagugcuccugcuaccccgacaccggcaccgugaugugcgugugccgcgacaacuggcacgggagcaaccggcccugggucuccuucaaccagaaccuggacuaccagaucggcuacaucugcucgggcguguucggggacaacccccgcccgaaggacggcgagggguccugcaaccccgugacggucgacggcgcggacggggugaagggcuucagcuaccgguacggcaacgggguguggaucggccgcaccaaguccaaccggcugcgcaagggguucgagaugaucugggaccccaacggcuggaccgacaccgacucggacuucuccaugaagcaggacgucguggccaugacggacuggagcggguacuccggcucguucgugcagcaccccgagcucaccggccuggacugcaugcggccgugcuucugggucgagcuggugcgcgggcucccccgggagaacaccaccaucuggacgagcggcuccucgaucuccuucugcggggucaacagcgacaccgccaacugguccuggcccgacggcgccgagcugcccuucaccaucgacaaguga

SEQ ID NO: 25534 - RNA, 1413 nt, Artificial Sequence
  derived and/or modified CDS sequence (AUadapt) from InfluenzaA__AFO64849__NA
augaaccccaaccagaagaucaucaccaucggcucgaucuccauggccaucgggaucaucucgcugauccuccagaucggcaacaucaucuccaucugggccagccacuccauccagaccgggucgcagaaccacacgggcaucugcaaccagcgcaucaucaccuacgagaacuccaccugggugaaccagaccuacgucaacaucaacaacacgaacgugguggcggggaaggacaagaccagcgucacccuggccggcaacuccucgcugugcccgauccggggcugggccaucuacaccaaggacaacuccauccgcaucgggucgaagggcgacguguucgugauccgggagcccuucaucuccugcagccaccucgagugccgcacguucuuccugacccagggggcccugcucaacgacaagcacuccaacggcaccgucaaggaccggucgcccuaccgcgcccugauguccugcccccugggggaggcgccgagccccuacaacucccgguucgagucgguggccuggagcgccuccgccugccacgacggcaugggcuggcucaccaucgggaucucgggccccgacaacggggcgguggccguccugaaguacaacggcaucaucacggagaccaucaaguccuggaagaagcagauccugcgcacccaggagucggagugcgugugcgugaacggcuccugcuucaccaucaugacggacgggcccagcaacggcgccgccuccuaccggaucuucaagaucgagaaggggaagaucaccaagucgaucgagcucgacgccccgaacucccacuacgaggagugcagcugcuaccccgacaccggcaccgucaugugcgugugccgcgacaacuggcacggguccaaccggcccugggugucguucaaccagaaccuggacuaccagaucggcuacaucugcuccggcgucuucggggacaacccccgcccgaaggacggcgaggggagcugcaaccccgugacgguggacggcgcggacggggucaagggcuucuccuaccgguacggcaacgggguguggaucggccgcaccaagucgaaccggcugcgcaagggguucgagaugaucugggaccccaacggcuggaccgacaccgacuccgacuucucggugaagcaggacgucguggccaugacggacugguccggguacagcggcucguucgugcagcaccccgagcucaccggccuggacugcaugcggccgugcuucugggucgagcuggugcgcgggcggccccgcgagaacgccaccaucuggaccuccggcagcuccaucucguucugcggggucaacuccgacacggccaacuggagcuggcccgacggcgccgagcuccccuucaccaucgacaaguga

SEQ ID NO: 25535 - RNA, 1413 nt, Artificial Sequence; identical to SEQ ID NO: 17370
  derived and/or modified CDS sequence (AUadapt) from InfluenzaA__AFO64860__NA

SEQ ID NO: 25536 - RNA, 1413 nt, Artificial Sequence
  derived and/or modified CDS sequence (AUadapt) from InfluenzaA__AFO64871__NA
augaaccccaaccagaagaucaucaccaucggcucgaucuccaucgccaucgggaucaucucgcugauccuccagaucggcaacaucaucuccaucugggccagccacuccauccagaccgggucgcagaaccacacgggcgugugcaaccagcgcaucaucaccuacgagaacuccaccugggucaaccagaccuacgugaacaucaacaacacgaacguggucgcggggaaggacaagaccagcaugacccuggccggcaacuccucgcugugcccgauccggggcugggccaucuacaccaaggacaacuccauccgcaucgggagcaagggcgacguguucgugauccgggagcccuucaucuccugcucgcaccucgagugccgcacguucuuccugacccagggggcccugcucaacgacaagcacuccaacggcaccgucaaggaccggagccccuaccgcgcccugauguccugcccccugggggaggcgccgucgcccuacaacucccgguucgagagcguggccuggucggccuccgccugccacgacggccucggcuggcugaccaucgggaucagcggccccgacaacggggcgguggccguccugaaguacaacggcaucaucacggagaccaucaaguccuggaagaagcgcauccuccggacccaggagucggagugcgugugcaugaacggcuccugcuucaccaucaugacggacgggcccagcaacggcgccgccuccuaccgcaucuucaagaucgagaaggggcgggugaccaagucgaucgagcuggacgccccgaacuaccacuacgaggagugcuccugcuaccccgacaccggcaccgucaugugcgugugccgcgacaacuggcacgggagcaaccggcccuggguguccuucaaccagaaccuggacuaccagaucggcuacaucugcucgggcgucuucggggacaacccccgcccgaaggacggcgagggguccugcaaccccgugacgguggacggcgcggacggggucaagggcuucagcuaccgguacggcaacgggguguggaucggccgcaccaaguccaaccggcuccgcaagggguucgagaugaucugggaccccaacggcuggaccgacaccgacucggacuucuccaugcggcaggacaucguggccaugacggacuggagcggguacuccggcucguucguccagcaccccgagcugaccggccuggacugcaugcgcccgugcuucuggguggagcucgugcgggggcugccccgcgagaacaccaccaucuggacgagcggcuccucgaucuccuucugcggggucaacagcgacaccgccaacugguccuggcccgacggcgccgagcugcccuucaccaucgacaaguga

SEQ ID NO: 25537 - RNA, 1413 nt, Artificial Sequence
  derived and/or modified CDS sequence (AUadapt) from InfluenzaA__AFO64882__NA
augaaccccaaccagaagaucaucaccaucggcucgaucuccaucgccaucgggaucaucucgcugaugcuccagaucggcaacaucaucuccaucugggccagccacuccauccagaccgggucgcagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucucgggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccucgaacggcgccgccuccuacaagaucuucaagaucgagaaggggaaggucaccaagagcaucgagcucaacgcccccaacucccacuacgaggagugcucgugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcgaggggucgugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucucggucaagcaggacgugguggccaucacggacuggagcggguacuccggcucguucguccagcaccccgagcucaccggccuggacugcauccgccccugcuucuggguggagcugguccgggggcgcccgcgggagaacaccaccaucuggacguccggcagcuccaucucguucugcggggugaacuccgacaccgccaacuggagcuggcccgacggcgccgagcuccccuucaccaucgacaaguga

SEQ ID NO: 25538 - RNA, 1413 nt, Artificial Sequence
  derived and/or modified CDS sequence (AUadapt) from InfluenzaA__AFO64893__NA
augaaccccaaccagaagaucaucaccaucggcucgaucuccguggccaucgggaucaucagccugaugcuccagaucggcaacaucaucuccaucugggccucgcacuccauccagaccgggagccagaaccacacgggcaucugcaaccagcgcaucaucaccuacgagaacuccaccugggucaaccacaccuacgugaacaucaacaacacgaacguggucgcggggaaggacaagaccucggugacccuggccggcaacuccagccugugcuccaucucgggcugggccaucuacaccaaggacaacuccauccggaucgggagcaagggcgacguguucgucauccgcgagccguucaucuccugcucgcaccucgagugccggacguucuuccugacccagggggcccugcucaacgacaagcacuccaacggcaccgugaaggaccgcagccccuaccgggcccugauguccugcccccugggggaggcgcccucgccguacaacagcaaguucgaguccguggccuggucggccuccgccugccacgacggcaugggcuggcucaccaucgggaucagcggccccgacaacggggcggucgccgugcugaaguacaacggcaucaucacggagaccaucaaguccuggaagaagcgcauccugcggacccaggagucggagugcgugugcgucaacggcuccugcuucaccaucaugacggacgggcccagcgacggcgccgccuccuacaagaucuucaagaucgagaaggggaaggugaccaagucgaucgagcucaacgcccccaacucccacuacgaggagugcagcugcuacccggacaccggcaccgugaugugcgucugccgcgacaacuggcacggguccaaccggcccugggugucguucaaccagaaccuggacuaccagaucggcuacaucugcuccggcguguucggggacaacccccgccccaaggacggcgaggggagcugcaacccggucacgguggacggcgcggacggggugaagggcuucuccuacaaguacggcaacggggucuggaucggccggaccaagucgaaccgcuuccggaagggguucgagaugaucugggaccccaacggcuggaccgacaccgacuccgacuucagcgugaagcaggacguggucgccaucacggacuggucgggguacuccggcagcuucgugcagcaccccgagcugaccggccucgacugcauccgccccugcuucugggucgagcuggugcgggggcgcccgcgggagaacaccaccaucuggacguccggcucguccaucagcuucugcggggugaacuccgacaccgccaacuggagcuggcccgacggcgccgagcugcccuucaccaucgacaaguga

SEQ ID NO: 25539 - RNA, 1413 nt, Artificial Sequence
  derived and/or modified CDS sequence (AUadapt) from InfluenzaA__AFO64904__NA
augaaccccaaccagaagaucaucaccaucggcucgaucuccguggccaucgggaucaucagccugauccuccagaucggcaacaucaucuccaugugggccucgcacuccauccagaccgggagccagaacuacacgggcaucugcaaccagcgcaucaucaccuacgagaacaacaccugggucaaccagaccuacgugaacaucaacaacacgaacguggucgcggggaaggacaagaucuccaugacccuggccggcaacucgucccugugcccgauccggggcugggccaucuacaccaaggacaacagcauccgcaucggguccaagggcgacguguucgugauccgggagcccuucaucucgugcucccaccucgagugccgcaccuucuuccugacgcagggggcccugcucaacgacaagcacagcaacggcaccgucaaggaccggucccccuaccgcgcccugaugucgugcccccugggggaggcgccgucccccuacaacagccgguucgaguccguggccuggucggccagcgccugccacgacggccucggcuggcugaccaucgggaucuccggccccgacaacggggcgguggccguccugaaguacaacggcaucaucaccgagacgaucaagucguggaagaagcagauccuccgcacccaggaguccgagugcgugugcgugaacggcagcugcuucaccaucaugaccgacgggcccuccaaccgggccgccucguaccgcaucuucaagaucgagaagggccgggucacgaaguccaucgagcuggacgccccgaacuaccacuacgaggagugcagcugcuaccccgacaccgggaccgugaugugcgugugccgcgacaacuggcacggcuccaaccggcccugggucucguucaaccagaaccuggacuaccagaucggguacaucugcuccggcguguucggcgacaacccccgcccgaaggacggggagggcagcugcaaccccgugaccgucgacggggcggacggcgugaagggguucuccuacaaguacggcaacggcguguggaucgggcggaccaagucgaaccgccuccggaagggcuucgagaugaucugggaccccaacggguggacggacaccgacuccgacuucagcaugaagcaggacgucguggccaugaccgacugguccggcuacucgggguccuucgugcagcaccccgagcugacgggccuggacugcaugcgcccgugcuucugggucgagcucgugcggggccugccccgcgagaacaccaccaucuggaccagcgggucguccaucagcuucugcggcgucaacuccgagacggccaacuggagcuggcccgacggggccgagcugcccuucaccaucgacaaguga

SEQ ID NO: 25540 - RNA, 1413 nt, Artificial Sequence
  derived and/or modified CDS sequence (AUadapt) from InfluenzaA__AFO65019__NA
augaaccccaaccagaagaucaucaccaucggcucgaucuccaucgccaucgggaucaucucgcugaugcuccagaucggcaacaucaucuccaucugggccagccacuccauccagaccgggucgcagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccucgccguacaacagcaaguucgaguccguggccuggucggccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacucccacuacgaggagugcagcugcuacccggacaccggcaccgugaugugcgugugccgcgacaacuggcacggguccaaccggcccugggucucguucaaccagaaccuggacuaccagaucggcuacaucugcuccggcguguucggggacaacccccgccccaaggacggcgaggggucgugcaacccggugacggcggacggcgccgacggggucaagggcuucuccuacaaguacggcaacgggguguggaucggccggaccaagagcaaccgccugcggaagggguucgagaugaucugggaccccaacggcuggaccgacaccgacuccgacuucucggugaagcaggacgucguggccaucacggacuggagcggguacuccggcucguucgugcagcaccccgagcucaccggccuggacugcauccgccccugcuucugggucgagcuggugcgggggcgcccgcgggagaacaccaccaucuggacguccggcagcuccaucucguucugcggggucaacuccgacaccgccaacuggagcuggcccgacggcgccgagcuccccuucaccaucgacaaguga

SEQ ID NO: 25541 - RNA, 1413 nt, Artificial Sequence; identical to SEQ ID NO: 18855
  derived and/or modified CDS sequence (AUadapt) from InfluenzaA__AFO65030__NA

SEQ ID NO: 25542 - RNA, 1413 nt, Artificial Sequence
  derived and/or modified CDS sequence (AUadapt) from InfluenzaA__AFO65041__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacguggucgcggggaaggacaagaccucggugacccuggccggcaacuccagccugugcuccaucagcggcugggccaucuacaccaaggacaacuccauccggaucgggucgaagggcgacguguucgucauccgcgagccguucaucuccugcagccaccucgagugccggacguucuuccugacccagggggcccugcucaacgacaagcacuccaacggcaccgugaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcggucgccgugcugaaguacaacggcaucaucacggagaccaucaaguccuggaagaagcagauccugcgcacccaggagucggagugcgugugcgucaacggcuccugcuucaccaucaugacggacgggcccagcaacggcgccgccuccuacaagaucuucaagaucgagaaggggaaggugaccaagucgaucgagcucaacgcccccaacuuccacuacgaggagugcuccugcuacccggacaccggcaccgugaugugcgucugccgggacaacuggcacgggagcaaccgccccuggguguccuucaaccagaaccuggacuaccagaucggcuacaucugcucgggcguguucggggacaacccccggcccaaggacggcgagggguccugcaacccggucacgguggacggcgcgaacggggugaagggcuucagcuacaaguacggcaacggggucuggaucggccgcaccaaguccaaccggcugcgcaagggguucgagaugaucugggaccccaacggcuggaccgacaccgacagcgacuucuccgugaagcaggacguggucgccaucacggacuggucgggguacagcggcuccuucgugcagcaccccgagcucaccggccuggacugcauccggcccugcuucugggucgagcuggugcgcgggcucccgcgggagaacaccaccaucuggacgucgggcuccagcaucuccuucugcggggugaacagcgacaccgccaacugguccuggcccgacggcgccgagcugcccuucaccaucgacaaguga

SEQ ID NO: 25543 - RNA, 1413 nt, Artificial Sequence
  derived and/or modified CDS sequence (AUadapt) from InfluenzaA__AFO65052__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacgugaucgcggggaaggacaagaccucgaugacccuggccggcaacuccagccugugcuccaucagcggcugggccaucuacaccaaggacaacuccauccggaucgggucgaagggcgacgucuucgugauccgcgagccguucaucuccugcagccaccucgagugccggacguucuuccugacccagggggcccugcucaacgacaagcacuccaacggcaccgugaaggaccgcucgcccuaccgggcccugauguccugcccccugggggaggcgcccagcccguacaacucgaaguucgaguccgucgccuggagcgccuccgccugcaacgacggcaugggcuggcucaccaucgggaucagcggccccgacaacggggcgguggccgugcugaaguacaacggcaucaucacggagaccaucaaguccuggaagaagcagauccugcgcacccaggagucggagugcgucugcgugaacggcuccugcuucaccaucaugacggacgggcccagcaacggcgccgccuccuacaagaucuucaagaucgagaaggggaaggugaccaagucgaucgagcucaacgcccccaacuuccacuacgaggagugcuccugcuacccggacaccggcaccgucaugugcgugugccgggacaacuggcacgggagcaaccgccccuggguguccuucaaccagaaccuggacuaccagaucggcuacaucugcucgggcgucuucggggacaacccccggcccaaggacggcgagggguccugcaacccggugacgguggacggcgcgaacggggucaagggcuucagcuacaaguacggcaacgggguguggaucggccgcaccaaguccaaccggcugcgcaagggguucgagaugaucugggaccccaacggcuggaccgacaccgacagcgacuucuccgugaagcaggacgucguggccaucacggacuggucgggguacagcggcuccuucgugcagcaccccgagcucaccggccuggacugcauccggcccugcuucugggucgagcuggugcgcgggcucccgcgggagaacaccaccaucuggacgucgggcuccagcaucuccuucugcggggucaacagcgacaccgccaacugguccuggcccgacggcgccgagcugcccuucaccaucgacaaguga

SEQ ID NO: 25544 - RNA, 1413 nt, Artificial Sequence; identical to SEQ ID NO: 17230
  derived and/or modified CDS sequence (AUadapt) from InfluenzaA__AFO66139__NA

SEQ ID NO: 25545 - RNA, 1413 nt, Artificial Sequence
  derived and/or modified CDS sequence (AUadapt) from InfluenzaA__AFO66150__NA
augaaccccaaccagaagaucaucaccaucggcucgaucuccguggccaucgggaucaucagccugauccuccagaucggcaacaucaucuccaucugggccucgcacuccauccagaccgggagccagaacuacacgggcaucugcaaccagcgcaucaucaccuacgagaaccggaccugggucaaccagaccuacgugaacaucaacaacacgaacguggucgcggggaaggacaagaccuccaugacccuggccggcaacucgucccugugcccgauccgcggcugggccaucuacaccaaggacaacagcauccggaucggguccaagggcgacguguucgugauccgcgagcccuucaucucgugcucccaccucgagugccggacguucuuccugacccagggggcccugcucaacgacaagcacagcaacggcaccaucaaggaccgcucccccuuccgggcccugaugucgugcccccugggggaggcgccgucccccuacaacagccgcuucgaguccgucgccuggucggccagcgccugccacgacggccucggcuggcugaccaucgggaucuccggccccgacaacggggcgguggccgugcugaaguacaacggcaucaucacggagaccaucaagucguggaagaagcagauccuccggacccaggaguccgagugcgucugcgugaacggcagcugcuucaccaucaugacggacgggcccuccaaccgcgccgccucguaccggaucuucaagaucgagaagggccgcgugaccaaguccaucgagcuggacgccccgaacuaccacuacgaggagugcagcugcuaccccgacaccgggaccgucaugugcgugugccgggacaacuggcacggcuccaaccgccccugggugucguucaaccagaaccuggacuaccagaucggguacaucugcuccggcgucuucggcgacaacccccggccgaaggacggggagggcagcugcaaccccgugacgguggacggggcggacggcgucaagggguucuccuaccgcuacggcaacggcguguggaucgggcggaccaagucgaaccgcauccggaagggcuucgagaugaucugggaccccaacggguggaccgacaccgacuccgacuucagcaugaagcaggacguggucgccaugacggacugguccggcuacucgggguccuucgugcagcaccccgagcucaccggccuggacugcaugcgcccgugcuucuggguggagcugguccggggccucccccgcgagaacaccaccaucuggacgagcgggucguccaucagcuucugcggcgugaacuccgagaccgccaacuggagcuggcccgacggggccgagcugcccuucaccaucgacaaguga

SEQ ID NO: 25546 - RNA, 1413 nt, Artificial Sequence
  derived and/or modified CDS sequence (AUadapt) from InfluenzaA__AFO66161__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacgugaucgcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaucugcgugugccgggacaacuggcacgggagcaaccgccccugggucuccuucaaccagaaccuggacuaccagaucggcuacaucugcucgggcguguucggggacaacccccggcccaaggacggcgagggguccugcaacccggugacggucgacggcgcgaacggggugaagggcuucagcuacaaguacggcaacgggguguggaucggccgcaccaaguccaaccggcugcgcaagggguucgagaugaucugggaccccaacggcuggaccgacaccgacagcgacuucuccgucaagcaggacgugguggccaucacggacuggucgggguacagcggcuccuucguccagcaccccgagcucaccggccuggacugcauccggcccugcuucuggguggagcugguccgcgggcucccgaaggagaacaccaccaucuggacgucgggcuccagcaucuccuucugcggggugaacagcgacaccgccaacugguccuggcccgacggcgccgagcugcccuucaccaucgacaaguga

SEQ ID NO: 25547 - RNA, 1413 nt, Artificial Sequence
  derived and/or modified CDS sequence (AUadapt) from InfluenzaA__AFO66172__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcaugaacggcuccugcuucaccaucaugacggacgggcccagcaacggcgccgccuccuacaagaucuucaagaucgagaaggggaaggugaccaagucgaucgagcucaacgcccccaacuuccacuacgaggagugcuccugcuacccggacaccggcaccgucaugugcgugugccgcgacaacuggcacgggagcaaccggcccuggguguccuucaaccagaaccuggacuaccagaucggcuacaucugcucgggcgucuucggggacaacccccgccccaaggacggcgagggguccugcaacccggugacgguggacggcgcggacggggucaagggcuucagcuacaaguacggcaacgggguguggaucggccggaccaaguccaaccgccugcggaagggguucgagaugaucugggaccccaacggcuggaccgacaccgacagcgacuucuccgugaagcaggacgucguggccaucacggacuggucgggguacagcggcuccuucgugcagcaccccgagcucaccggccuggacugcauccgccccugcuucugggucgagcuggugcgggggcucccgcgcgagaacaccaccaucuggacgucgggcuccagcaucuccuucugcggggucaacagcgacaccgccaacugguccuggcccgacggcgccgagcugcccuucaccaucgacaaguga

SEQ ID NO: 25548 - RNA, 1413 nt, Artificial Sequence; identical to SEQ ID NO: 17332
  derived and/or modified CDS sequence (AUadapt) from InfluenzaA__AFO66183__NA

SEQ ID NO: 25549 - RNA, 1413 nt, Artificial Sequence
  derived and/or modified CDS sequence (AUadapt) from InfluenzaA__AFO66194__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacgugaucgcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcucgggcguguucggggacaacccccggcccaaggacggcgagggguccugcaacccggugacggucgacggcgcgaacggggugaagggcuucagcuacaaguacggcaacgggguguggaucggccgcaccaaguccaaccggcugcgcaagggguucgagaugaucugggaccccaacggcuggaccgacaccgacagcgacuucuccgucaagcaggacaucguggccaucacggacuggucgggguacagcggcuccuucgugcagcaccccgagcucaccggccuggacugcauccggcccugcuucugggucgagcuggugcgcgggcucccgaaggagaacaccaccaucuggacgucgggcuccagcaucuccuucugcggggucaacagcgacaccgccaacugguccuggcccgacggcgccgagcugcccuucaccaucgacaaguga

SEQ ID NO: 25550 - RNA, 1410 nt, Artificial Sequence; identical to SEQ ID NO: 18957
  derived and/or modified CDS sequence (AUadapt) from InfluenzaA__AFO66205__NA

SEQ ID NO: 25551 - RNA, 1413 nt, Artificial Sequence; identical to SEQ ID NO: 16817
  derived and/or modified CDS sequence (AUadapt) from InfluenzaA__AFO66216__NA

SEQ ID NO: 25552 - RNA, 1413 nt, Artificial Sequence; identical to SEQ ID NO: 16788
  derived and/or modified CDS sequence (AUadapt) from InfluenzaA__AFO66227__NA

SEQ ID NO: 25553 - RNA, 1413 nt, Artificial Sequence
  derived and/or modified CDS sequence (AUadapt) from InfluenzaA__AFO66238__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagucggagugcgugugcaugaacggcuccugcuucaccaucaugacggacgggcccagcaacggcgccgccuccuacaagaucuucaagaucgagaaggggaaggugaccaagucgaucgagcucaacgcccccaacuuccacuacgaggagugcuccugcuacccggacaccggcaccgucaugugcgugugccgggacaacuggcacgggagcaaccgccccuggguguccuucaaccagaaccuggacuaccagaucggcuacaucugcucgggcgucuucggggacaacccccggcccaaggacggcgagggguccugcaacccggugacgguggacggcgcggacggggucaagggcuucagcuacaaguacggcaacgggguguggaucggccgcaccaaguccaaccggcugcgcaagggguucgagaugaucugggaccccaacggcuggaccaacaccgacagcgacuucuccgugaagcaggacgucguggccaucacggacuggucgggguacagcggcuccuucgugcagcaccccgagcucaccggccuggacugcauccggcccugcuucugggucgagcuggugcgcgggcucccgcgggagaacaccaccaucuggacgucgggcuccagcaucuccuucugcggggucaacagcgacaccgccaacugguccuggcccgacggcgccgagcugcccuucaccaucgacaaguga

SEQ ID NO: 25554 - RNA, 1413 nt, Artificial Sequence
  derived and/or modified CDS sequence (AUadapt) from InfluenzaA__AFO66249__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacggggccgccuccuacaagaucuucaagaucgagaagggcaaggugaccaagucgaucgagcucaacgcccccaacuuccacuacgaggagugcuccugcuacccggacaccgggaccgucaugugcgugugccgggacaacuggcacggcagcaaccgccccuggguguccuucaaccagaaccuggacuaccagaucggcuacaucugcucgggggucuucggcgacaacccccggcccaaggacggggagggcuccugcaacccggugacgguggacggggcggacggcgucaagggcuucagcuacaaguacgggaacggcguguggaucgggcgcaccaaguccaaccggcugcgcaagggcuucgagaugaucugggaccccaacggguggaccaacaccgacagcgacuucuccgugaagcaggacgucguggccaucacggacuggucgggcuacagcggcuccuucgugcagcaccccgagcucaccgggcuggacugcauccggcccugcuucugggucgagcuggugcgcggccucccgcgggagaacaccaccaucuggacgucgggguccagcaucuccuucugcggcgucaacagcgacaccgccaacugguccuggcccgacggcgccgagcugcccuucaccaucgacaaguga

SEQ ID NO: 25555 - RNA, 1413 nt, Artificial Sequence
  derived and/or modified CDS sequence (AUadapt) from InfluenzaA__AFP33330__NA
augaaccccaaccagaagaucaucaccaucggcucgaucuccguggccaucgggaucaucagccugauccuccagaucggcaacaucaucuccaucugggccucgcacuccauccaggcggggagccagaacuacaccggcaucugcaaccagaagaucaucacguacgagaaccgcaccugggucaaccagaccuacgugaacaucaacaacaccaacguggucgccgggaaggacaagacguccaugacccuggccggcaacucgucccugugcccgauccggggcugggccaucuacaccaaggacaacagcauccgcaucggguccaagggcgacguguucgugauccgggagcccuucaucucgugcucccaccucgagugccgcaccuucuuccugacgcagggggcccugcucaacgacaagcacagcaacggcaccaucaaggaccggucccccuuccgcgcgcugaugucgugcccccugggggaggccccgucccccuacaacagccgguucgaguccgucgccuggucggccagcgcgugccacgacggccucggcuggcugaccaucgggaucuccggccccgacaacggggccguggccgugcugaaguacaacggcaucaucaccgagacgaucaagucguggaagaagcagauccuccgcacccaggaguccgagugcgucugcgugaacggcagcugcuucaccaucaugaccgacgggcccuccaaccgggccgccucguaccgcaucuucaagaucgagaagggccgggugacgaaguccaucgagcuggacgcgccgaacuaccacuacgaggagugcagcugcuaccccgacaccgggaccgucaugugcgugugccgcgacaacuggcacggcuccaaccggcccugggugucguucaaccagaaccuggacuaccagaucggguacaucugcuccggcgucuucggcgacaacccccgcccgaaggacggggagggcagcugcaaccccgugaccguggacggggccgacggcgucaagggguucuccuaccgguacggcaacggcguguggaucgggcgcaccaagucgaaccggcuccgcaagggcuucgagaugaucugggaccccaacggguggacggacaccgacuccgacuucagcaugaagcaggacguggucgccaugaccgacugguccggcuacucgggguccuucgugcagcaccccgagcugacgggccuggacugcaugcggccgugcuucuggguggagcucguccgcggccugccccgggagaacaccaccaucuggaccagcgggucguccaucagcuucugcggcgugaacuccgagacggccaacuggagcuggcccgacggggccgagcugcccuucaccaucgacaaguga

SEQ ID NO: 25556 - RNA, 1413 nt, Artificial Sequence
  derived and/or modified CDS sequence (AUadapt) from InfluenzaA__AFP33331__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugaucgcggggaaggacaagaccucggugacccuggccggcaacuccagccugugcuccaucagcggcugggccaucuacaccaaggacaacuccauccggaucgggucgaagggcgacgucuucgugauccgcgagccguucaucuccugcagccaccucgagugccggacguucuuccugacccagggggcccugcucaacgacaagcacuccaacggcaccgugaaggaccgcucgcccuaccgggcccugauguccugcccccugggggaggcgcccagcccguacaacucgaaguucgaguccgucgccuggagcgccuccgccugccacgacggcaugggcuggcucaccaucgggaucagcggccccgacaacggggcgguggccgugcugaaguacaacggcaucaucacggagaccaucaaguccuggaagaagcgcauccugcggacccaggagucggagugcgucugcgugaacggcuccugcuucaccaucaugacggacgggcccagcaacggcgccgccuccuacaagaucuucaagaucgagaaggggaaggugaccaagucgaucgagcucaacgcccccaacuuccacuacgaggagugcuccugcuacccggacaccggcaccgucaugugcgugugccgcgacaacuggcacgggagcaaccggcccuggguguccuucaaccagaaccuggacuaccagaucggcuacaucugcucgggcgucuucggggacaacccccgccccaaggacggcgagggguccugcaacccggugacgguggacggcgcggacggggucaagggcuucagcuacaaguacggcaacgggguguggaucggccggaccaaguccaaccgccugcggaagggguucgagaugaucugggaccccaacggcuggaccgacaccgacagcgacuucuccgugaagcaggacgucguggccaucacggacuggucgggguacagcggcuccuucgugcagcaccccgagcucaccggccuggacugcauccgccccugcuucugggucgagcuggugcgggggcucccgcgcgagaacaccaccaucuggacgucgggcuccagcaucuccuucugcggggucaacagcgacaccgccaacugguccuggcccgacggcgccgagcugcccuucaccaucgacaaguga

SEQ ID NO: 25557 - RNA, 1410 nt, Artificial Sequence; identical to SEQ ID NO: 23545
  derived and/or modified CDS sequence (AUadapt) from InfluenzaA__AFQ32576__NA

SEQ ID NO: 25558 - RNA, 1410 nt, Artificial Sequence
  derived and/or modified CDS sequence (AUadapt) from InfluenzaA__AFQ37282__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucgugcagcacccggagcugacgggccuggacugcauccgccccugcuucugggucgagcucauccggggccgccccaaggagaacaccaucuggaccgggggcagcuccaucagcuucugcggggugaacuccgacaccgucggcuggagcuggcccgacggcgccgagcugccguucacgaucgacaaguga

SEQ ID NO: 25559 - RNA, 1410 nt, Artificial Sequence
  derived and/or modified CDS sequence (AUadapt) from InfluenzaA__AFQ55691__NA
augaaccccaaccagaagaucaucaccaucggcguggucaacaccacgcugucgaccaucgcccuccugaucggggugggcaaccugguguucaacaccgucauccacgagaagaucggggaccaccagaccgugacgcacccgaccaccaccacgcccgccauccccaacugcuccgacaccaucaucaccuacaacaacaccaucaucaacaacaucacgaccaccaucaucaccgaggcggagcgccccuucaagucgccgcucccccugugccccuuccggggcuucuuccccuuccacaaggacaacgccauccgccugggggagaacaaggacgugaucgucacgcgggagccguacguguccugcgacaacgacaacugcuggucguucgcccucgcccagggcgcccugcugggcaccaagcacuccaacgggaccaucaaggaccgcacccccuaccggucgcucauccgcuuccccaucggcacggcgcccgugcuggggaacuacaaggagaucugcaucgccugguccucguccucgugcuucgacggcaaggaguggaugcacgucugcaugaccgggaacgacaacgacgccuccgcccagaucaucuacgcgggcaagaugaccgacucgaucaaguccuggcggaaggacauccugcgcacccaggagucggagugccagugcaucgacggcacgugcgugguggccgucaccgacgggccggccgccuccucggccgaccaccggaucuacuggauccgcgagggcaagaucaucaaguacgaggacgugcccaagaccaagauccagcaccucgaggagugcuccugcuacguggacgucgacguguacugcaucugccgggacaacuggaaggggucgaaccgccccuggaugcggaucaacaacgagaccauccuggagacgggcuacgugugcuccaaguuccacucggacacgccccgcccggcggaccccucgaccgucuccugcgacucgcccuccaacgugaacggcgggcccggcgugaagggguucggcuucaaggccgggaacgacgucuggcugggccggaccgugucgaccuccggccgcucgggguucgagaucaucaaggugaccgagggcuggaucaacuccccgaaccacgccaagucgaucacccagacccucauguccaacaacgacuggucgggguacuccggcucguucaucaucaagacgaaggacugcuuccagcccugcuucuacgucgagcugauccgggggcgccccaacaagaacgacgacguguccuggaccucgaacuccaucgucaccuucugcggccuggacaacgagcccggcucggggaacuggccggacggcuccaacaucggguucaugcccaaguga

SEQ ID NO: 25560 - RNA, 1410 nt, Artificial Sequence
  derived and/or modified CDS sequence (AUadapt) from InfluenzaA__AFR68156__NA
augaaccccaaccagaagaucaucaccaucggcucggugugcaugaccaucgggauggccaaccugauccuccagaucggcaacaucaucuccaucuggaucagccacuccauccagcugcgcaaccagagccagaucgagacgugcaaccaguccgucaucaccuacgagaacaacaccugggugaaccagaccuacgugaacaucagcaacacgaacuucgccgcggggcaguccgucgugucggugaagcuggccggcaacuccagccucugcccggucuccgggugggccaucuacagcaaggacaacuccauccggaucggcagcaagggcgacguguucgugauccgcgagcccuucaucuccugcagcccccuggagugccggaccuucuuccugacccagggggcccuccugaacgacaagcacuccaacggcaccaucaaggaccgcucgcccuaccggacgcugauguccugcccgaucggggagguccccagccccuacaacagccgcuucgaguccguggccuggagcgcguccgccugccacgacggcaucaacuggcucaccaucgggaucagcggccccgacaacggcgccguggccguccugaaguacaacgggaucaucaccgacaccaucaaguccuggcggaacaacauccugcgcacgcaggagucggagugcgcgugcgugaacggcuccugcuucaccaucaugaccgacgggccgagcgacggccaggccuccuacaagaucuuccggaucgagaagggcaagaucgucaagagcguggagaugaacgcccccaacuaccacuacgaggagugcuccugcuaccccgacagcuccgagaucacgugcgugugccgcgacaacuggcacgggagcaaccggcccuggguguccuucaaccagaaccucgaguaccagaucggcuacaucugcucggggaucuucggcgacaacccgcgccccaacgacaagaccggguccugcggccccgucagcuccaacggcgccaacggggugaagggcuucagcuucaaguacgggaacggcguguggaucgggcggaccaagagcaucuccagccgcaagggcuucgagaugaucugggaccccaacggcuggaccgggaccgacaacaacuucuccaucaagcaggacaucgucggcaucaacgaguggucgggguacuccggcagcuucgugcagcacccggagcugacggggcuggacugcauccggcccugcuucuggguggagcucauccgcggccggcccaaggagaacaccaucuggaccuccggcagcuccaucagcuucugcggggucaacuccgacaccgugggcuggagcuggcccgacggggccgagcugccguucacgaucgacaaguga

SEQ ID NO: 25561 - RNA, 1410 nt, Artificial Sequence; identical to SEQ ID NO: 25560
  derived and/or modified CDS sequence (AUadapt) from InfluenzaA__AFR68166__NA

SEQ ID NO: 25562 - RNA, 1410 nt, Artificial Sequence
  derived and/or modified CDS sequence (AUadapt) from InfluenzaA__AFR68176__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggccucgugguccaaggacauccugcgcacccaggagucggagugcgucugcaucaacggcacgugcgccguggugaugaccgacggguccgcgagcggcaaggccgacaccaagauccucuucaucaaggagggcaagaucguccacaccucgacgcuguccgggagcgcccagcacguggaggagugcuccugcuacccccgguaccccggcgugcgcugcgucugccgggacaacuggaaggggucgaaccgcccgaucguggacaucaacaucaaggaccacuccaucgugucguccuacgucugcagcggccuggugggcgacacgccccggaagaacgacuccucguccagcgggcacugccucgaccccaacaacgaggagggcgggcacggcgugaaggggugggccuucgacgacggcaacgacgucuggaugggccgcaccaucaacgagaccucccggcugggguacgagaccuucaaggugaucgagggcuggucgaaccccaaguccaagcugcagaucaaccgccaggucaucguggaccgggggaaccgcucgggcuacuccgggaucuucagcguggagggcaagaacugcaucaaccggugcuucuacgucgagcucauccgcggccggaaggaggagaccgaggugcuguggaccuccaacucgaucguggucuucugcgggaccagcggcacguacgggaccggcuccuggccggacggggccgaccugaaccucaugcccaucuga

SEQ ID NO: 25563 - RNA, 1410 nt, Artificial Sequence; identical to SEQ ID NO: 16318
  derived and/or modified CDS sequence (AUadapt) from InfluenzaA__AFR84677__NA

SEQ ID NO: 25564 - RNA, 1410 nt, Artificial Sequence; identical to SEQ ID NO: 20027
  derived and/or modified CDS sequence (AUadapt) from InfluenzaA__AFR84687__NA

SEQ ID NO: 25565 - RNA, 1410 nt, Artificial Sequence; identical to SEQ ID NO: 16274
  derived and/or modified CDS sequence (AUadapt) from InfluenzaA__AFR84696__NA

SEQ ID NO: 25566 - RNA, 1410 nt, Artificial Sequence; identical to SEQ ID NO: 16318
  derived and/or modified CDS sequence (AUadapt) from InfluenzaA__AFR84706__NA

SEQ ID NO: 25567 - RNA, 1410 nt, Artificial Sequence; identical to SEQ ID NO: 16274
  derived and/or modified CDS sequence (AUadapt) from InfluenzaA__AFR84716__NA

SEQ ID NO: 25568 - RNA, 1410 nt, Artificial Sequence; identical to SEQ ID NO: 16274
  derived and/or modified CDS sequence (AUadapt) from InfluenzaA__AFR84726__NA

SEQ ID NO: 25569 - RNA, 1410 nt, Artificial Sequence; identical to SEQ ID NO: 16274
  derived and/or modified CDS sequence (AUadapt) from InfluenzaA__AFR84736__NA

SEQ ID NO: 25570 - RNA, 1410 nt, Artificial Sequence; identical to SEQ ID NO: 16274
  derived and/or modified CDS sequence (AUadapt) from InfluenzaA__AFR84746__NA

SEQ ID NO: 25571 - RNA, 1410 nt, Artificial Sequence; identical to SEQ ID NO: 16274
  derived and/or modified CDS sequence (AUadapt) from InfluenzaA__AFR84756__NA

SEQ ID NO: 25572 - RNA, 1410 nt, Artificial Sequence; identical to SEQ ID NO: 16274
  derived and/or modified CDS sequence (AUadapt) from InfluenzaA__AFR84766__NA

SEQ ID NO: 25573 - RNA, 1410 nt, Artificial Sequence; identical to SEQ ID NO: 16274
  derived and/or modified CDS sequence (AUadapt) from InfluenzaA__AFR84776__NA

SEQ ID NO: 25574 - RNA, 1410 nt, Artificial Sequence; identical to SEQ ID NO: 16274
  derived and/or modified CDS sequence (AUadapt) from InfluenzaA__AFR84786__NA

SEQ ID NO: 25575 - RNA, 1410 nt, Artificial Sequence; identical to SEQ ID NO: 16274
  derived and/or modified CDS sequence (AUadapt) from InfluenzaA__AFR84796__NA

SEQ ID NO: 25576 - RNA, 1410 nt, Artificial Sequence; identical to SEQ ID NO: 16318
  derived and/or modified CDS sequence (AUadapt) from InfluenzaA__AFR84806__NA

SEQ ID NO: 25577 - RNA, 1410 nt, Artificial Sequence; identical to SEQ ID NO: 16274
  derived and/or modified CDS sequence (AUadapt) from InfluenzaA__AFR84816__NA

SEQ ID NO: 25578 - RNA, 1410 nt, Artificial Sequence; identical to SEQ ID NO: 16318
  derived and/or modified CDS sequence (AUadapt) from InfluenzaA__AFR84826__NA

SEQ ID NO: 25579 - RNA, 1410 nt, Artificial Sequence
  derived and/or modified CDS sequence (AUadapt) from InfluenzaA__AFR84836__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucggcggcugggccaucuacagcaaggacaacuccgugcgcaucgggagcaagggcgacguguucgucauccgggagcccuucaucuccugcagcccccuggagugccgcaccuucuuccugacccagggggcccuccugaacgacaagcacuccaacggcaccaucaaggaccggucgcccuaccgcacgcugauguccugcccgaucggggaggugcccagccccuacaacucccgguucgagagcguggccuggagcgcguccgccugccacgacggcaucaacuggcucaccaucggcaucucggggcccgacaacggcgccgucgccgugcugaaguacaacgggaucaucaccgacaccaucaaguccuggcgcaacaacauccugcggacgcaggagagcgagugcgcgugcgugaacggcuccugcuucaccgucaugaccgacggcccgagcaacgggcaggccuccuacaagaucuuccgcaucgagaagggcaagaucgucaagagcguggagaugaacgcccccaacuaccacuacgaggagugcuccugcuaccccgacucguccgagaucacgugcgugugccgggacaacuggcacgggagcaaccgccccuggguguccuucaaccagaaccucgaguaccagaucggcuacaucugcagcgggaucuucggcgacaacccgcggcccaacgacaagaccggcuccugcgggcccgugagcuccaacggcgccaacggggucaagggcuucucguucaaguacgggaacggcguguggaucggccgcaccaaguccaucagcagccggaacggguucgagaugaucugggaccccaacggcuggaccgagaccgacaacaacuucuccaucaagcaggacaucguggggaucaacgaguggagcggcuacuccgggucguucguccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 25580 - RNA, 1410 nt, Artificial Sequence; identical to SEQ ID NO: 19944
  derived and/or modified CDS sequence (AUadapt) from InfluenzaA__AFR84846__NA

SEQ ID NO: 25581 - RNA, 1410 nt, Artificial Sequence; identical to SEQ ID NO: 16318
  derived and/or modified CDS sequence (AUadapt) from InfluenzaA__AFR84856__NA

SEQ ID NO: 25582 - RNA, 1410 nt, Artificial Sequence
  derived and/or modified CDS sequence (AUadapt) from InfluenzaA__AFR84866__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuuccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 25583 - RNA, 1410 nt, Artificial Sequence; identical to SEQ ID NO: 19848
  derived and/or modified CDS sequence (AUadapt) from InfluenzaA__AFR84876__NA

SEQ ID NO: 25584 - RNA, 1410 nt, Artificial Sequence; identical to SEQ ID NO: 19944
  derived and/or modified CDS sequence (AUadapt) from InfluenzaA__AFR84895__NA

SEQ ID NO: 25585 - RNA, 1410 nt, Artificial Sequence; identical to SEQ ID NO: 19944
  derived and/or modified CDS sequence (AUadapt) from InfluenzaA__AFR84905__NA

SEQ ID NO: 25586 - RNA, 1410 nt, Artificial Sequence; identical to SEQ ID NO: 19944
  derived and/or modified CDS sequence (AUadapt) from InfluenzaA__AFR84915__NA

SEQ ID NO: 25587 - RNA, 1410 nt, Artificial Sequence; identical to SEQ ID NO: 19944
  derived and/or modified CDS sequence (AUadapt) from InfluenzaA__AFR84925__NA

SEQ ID NO: 25588 - RNA, 1353 nt, Artificial Sequence
  derived and/or modified CDS sequence (AUadapt) from InfluenzaA__AFU83119__NA
augaaucccaaccagaagaucaucaccaucggcagcgugucccugaccaucgccacggucugcuuccucaugcagaucgccauccuggcgaccaccgugacccugcacuuuaagcagaacgagugcagcaucccguccagcaaccaggugguccccugugagcccaucaucguggagcgcaacgugacggaguaccgggacugguccaagccccagugccagaucaccggguucgccccguucaguaaggacaacuccauccgccucagcgccggcggggacaucugggucacccgggagcccuacguguccuguagccccgacaagugcuaccaguucgcccugggccaggggaccacgcuggauaacaagcacuccaacggcaccauccacgaccgcaucccccaccggacccuccugaugaaugagcugggcgugccguuccaccucgggaccaagcaggucugcaucgccuggagcuccagcuccugucacgacggccgcgcguggcugcacgugugcgugacgggggacgaucggaacgccaccgccagcuucaucuacgacggcguccugguggacuccaucgggaguuggucccagaacauccuccgcacccaggagagcgagugcgugugcaucaacgggaccuguacggucgugaugaccgacggcagcgccuccggccgggcggacacccgcauccuguucaucaaggagggcaagaucgugcacgucagcccccuguccgggagugcccagcacaucgaggagugcuccugcuacccccgguaccccgaugugcgcugcgugugccgggacaacuggaagggcagcaaucgcccgaucaucgacaucuccauggccgacuacggcaucgacagcuccuacgucuguagcgggcucgugggcgacacgccccggaacgacgacuccaguuccaacagcaacugcaaggaccccaauaacgagcgcgggaaccccggcgugaaggggugggccuucgacuacggcaacgaugucuggaugggccggaccaucuccaaggacagccgcuccggguacgagaccuuccgggugaucggcggguggaccaucgccaacaguaagucccaggucaaccgccaggugaucguggacaacaacaacuggaguggcuacagcgggaucuucuccgucgagggcaagagcugcaucaaccgguguuucuacguggagcugauccgcggccgcccgcaggagacccgggugugguggacguccaacagcaucgucgcguucugugggaccuccggcaccuacgggaccggcagcuggcccgacggggccaacaucaacuucaugcccaucuga

SEQ ID NO: 25589 - RNA, 1410 nt, Artificial Sequence
  derived and/or modified CDS sequence (AUadapt) from InfluenzaA__AFV53208__NA
augaaccccaaccagaagaucaucaccaucggcucggugucccugaccaucgccacggucugcuuccucauccagaucgccauccuggugaccaccgugacccugcacuucaagcagcacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgccggcggggacaucugggugacgcgggagcccuacgugucgugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcaucgccuggagcuccucguccugccacgacggcaaggcguggcugcacgugugcaucaccggggacgacaagaacgccaccgccucguucaucuacgacggccggcucauggacuccaucgggagcuggucccagaacauccugcgcacgcaggagucggagugcgucugcaucaacgggaccugcaccguggugaugaccgacggcuccgccucgggccgggcggacacgcgcauccuguucaucgaggagggcaagaucguccacaucagcccccucuccgggucggcccagcacguggaggagugcuccugcuacccccgguacccgggcgugcgcugcaucugccgggacaacuggaagggcagcaaccgccccgucaucgacaucaacauggaggacuacuccaucgacucguccuacgugugcucggggcuggugggcgacacgccccggaacgacgaccgcuccagcaacuccaacugccggaaccccaacaacgagcgcgggaaccagggcgucaaggggugggccuucgacaacggcgacgacguguggaugggccggaccaucucgaaggaccugcgcuccggguacgagaccuucaaggugaucggcggguggucgaccccgaacuccaagagccagaucaaccggcaggucaucguggacuccgacaaccgcucgggcuacuccgggaucuucucggucgagggcaagagcugcaucaaccgcugcuucuacguggagcucauccggggccgcaagcaggagacccgggugugguggaccuccaacucgaucgucguguucugcgggaccuccggcacguacgggaccggcagcuggcccgacggggccaacaucaacuucaugcccaucuga

SEQ ID NO: 25590 - RNA, 1410 nt, Artificial Sequence
  derived and/or modified CDS sequence (AUadapt) from InfluenzaA__AFV53219__NA
augaaccccaaccagaagaccaucaccaucggcucggugucccugacgaucgccaccgucugcuuccucaugcagaucgccauccuggcgaccaccgugacgcugcacuucaagcagcacgagugcgacucgccggccuccaaccaggugaugcccugcgagcccaucaucaucgagcgcaacaucaccgagaucgucuaccucaacaacaccaccaucgagaaggagaucugccccgaggugguggaguaccggaacuggucgaagccgcagugccagaucacgggguucgcccccuucuccaaggacaacagcauccgccuguccgccggcggggacaucugggucacccgggagcccuacgugucgugcgaccccggcaagugcuaccaguucgcccuggggcagggcaccacccucgacaacaagcacuccaacggcacgauccacgaccgcaucccgcaccggacccugcugaugaacgagcucggggugcccuuccaccugggcaccaagcaggucugcguggcguggucguccucguccugccacgacgggaaggccuggcugcacgugugcgucaccggcgacgaccgcaacgccacggccagcuucaucuacgacgggcggcucguggacuccaucggcucguggucccagaacauccugcgcacccaggagucggagugcgugugcaucaacgggaccugcaccgucgugaugacggacggcuccgcgagcggccgggccgacacccgcauccuguucaucaaggaggggaagaucgugcacaucucgccccucuccggcucggcccagcacaucgaggagugcuccugcuacccccgguacccggacguccgcugcaucugccgggacaacuggaagggcucgaaccgccccgugaucgacaucaacauggaggacuacuccaucgacagcuccuacgugugcucggggcuggucggcgacacgccccggaacgacgacuccucguccaacagcaacugccgcgaccccaacaacgagcgggggaacccgggcgugaaggggugggccuucgacaacggcgacgacguguggaugggccgcaccaucaacaaggagucccggucgggguacgagaccuucaaggucaucggcgggugguccacccccaacucgaagucccaggugaaccgccaggucaucguggacaacaacaacuggucgggcuacuccgggaucuucagcguggagggcaagucgugcaucaaccggugcuucuacgucgagcugauccgcggccgcccccaggagacccgggugugguggaccuccaacucgaucguggucuucugcgggacguccggcaccuacgggaccggcagcuggcccgacggggccaacaucaacuucaugccgaucuga

SEQ ID NO: 25591 - RNA, 1410 nt, Artificial Sequence
  derived and/or modified CDS sequence (AUadapt) from InfluenzaA__AFV53230__NA
augaaccccaaccagaagaucaucaccaucggcucggugucccugaccaucgccacggucugcuuccucaugcagaucgccauccuggugaccaccgugacccugcacuucaagcagcacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugcaagaucaccggguucgcccccuucuccaaggacaacucgauccgccuguccgccggcggggacaucugggugacgcgggagcccuacgugucgugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcaucgccuggagcuccucguccugccacgacggcaaggcguggcugcacgugugcgucaccggggacgacaagaacgccaccgccucguucaucuacgacggccggcucguggacuccaucgggagcuggucccagaacauccugcgcacgcaggagucggagugcgugugcaucaacgggaccugcaccgucgugaugaccgacggcuccgccucgggccgggcggacacgaagauccuguucaucgaggagggcaagaucgugcacaucagcccccucuccgggucggcccagcacgucgaggagugcuccugcuacccccgcuacccggacgugcggugcaucugccgcgacaacuggaagggcagcaaccggcccguggucgacaucuccauggaggacuacucgaucgacuccucguacgugugcuccggccuggugggggacacgccccgcaacgacgaccggagcuccaacucgaacugccgcaaccccaacaacgagcggggcaaccagggggucaagggcugggccuucgacaacggggacgacguguggaugggccgcaccaucuccaaggaccugcggucgggcuacgagaccuucaaggucaucgggggcugguccaccccgaacagcaagucccagaucaaccgccaggugaucguggacucggacaaccgguccggguacucgggcaucuucagcgucgaggggaaguccugcaucaaccgcugcuucuacguggagcucauccgcggccggaagcaggagacccgcgugugguggaccucgaacuccaucgucguguucugcggcaccagcgggacguacggcaccggguccuggcccgacggcgccaacaucaaccugaugcccaucuga

SEQ ID NO: 25592 - RNA, 1410 nt, Artificial Sequence; identical to SEQ ID NO: 18807
  derived and/or modified CDS sequence (AUadapt) from InfluenzaA__AFV53241__NA

SEQ ID NO: 25593 - RNA, 1410 nt, Artificial Sequence; identical to SEQ ID NO: 16493
  derived and/or modified CDS sequence (AUadapt) from InfluenzaA__AFV53252__NA

SEQ ID NO: 25594 - RNA, 1413 nt, Artificial Sequence
  derived and/or modified CDS sequence (AUadapt) from InfluenzaA__AFV53263__NA
augaaccccaaccagaagaucaucaccaucggcucgaucugcauggccaucgggaccaucucccugauccuccagaucggcaacaucaucagcaucuggaucucccacucgauccagacggggucccagaaccacaccggcaucugcaaccagcgcaucaucaccuacgagaacaacaccugggugaaccagacguacgucaacaucagcaacaccaacgugguggccgggaaggacaccaccuccaugauccuggcgggcaacucgucccugugcccgauccggggcugggccaucuacagcaaggacaacuccauccgcaucgggagcaagggcgacgucuucgugauccgggagcccuucaucuccugcucgcaccucgagugccgcacguucuuccugacccagggggcccugcucaacgacaagcacuccaacggcaccgugaaggaccggagccccuaccgcgcccugauguccugccccaucggggaggccccgucgcccuacaacucccgguucgagagcgucgcguggucggccuccgccugccacgacggcaugggcuggcugaccaucgggaucagcggccccgacgacggggccguggcggugcucaaguacaacggcaucaucacggagaucaucaaguccuggcgcaagcagauccugcggacccaggagagcgagugcgucugcgugaacggcuccugcuucaccaucaugaccgacgggcccucgaaccgcccggccuccuaccggaucuucaagaucgagaagggcaagaucaccaagagcaucgagcuggacgcccccaacucccacuacgaggagugcucgugcuaccccgacacggggaaggugaugugcgucugccgcgacaacuggcacggcuccaaccggcccugggugagcuucaaccagaaccucgacuaccagaucggguacaucugcuccggcguguucggcgacaacccgcgccccaaggacgggaagggcucgugcgaccccgucaacguggacggggccgacggcgugaagggguucuccuaccgguacggcaacggcgucuggaucgggcgcaccaagagcaacuccagccggaagggcuucgagaugaucugggaccccaacggguggaccaacacggacggcaacuucuccgugaagcaggacguggucgccaugaccgacuggucgggguacagcggcuccuucgugcagcacccggagcugaccggccuggacugcauccgccccugcuucuggguggagcucauccgggggcgcccccgggaggagaccacgaucuggaccucgggcuccagcaucuccuucugcggggucaacagcgacaccgugaacugguccuggcccgacggcgcggagcugccguucaccaucgacaaguga

SEQ ID NO: 25595 - RNA, 1410 nt, Artificial Sequence
  derived and/or modified CDS sequence (AUadapt) from InfluenzaA__AFV53274__NA
augaaccccaaccagaagaucaucaccaucggcucggugucccugaucaucgccaccgucugcuuccucaugcagaucgccauccuggugacgaccgugacccugcacuucaagcagcacgagugcgacucgccggcguccaaccaggucaugcccugcgagcccaucaucaucgagcgcaacaucaccgagaucguguaccucaacaacacgaccaucgagaaggagaucugccccaagguggucgaguaccggaacuggagcaagccgcagugccagaucaccggguucgcccccuucuccaaggacaacucgauccgccuguccgccggcggggacaucugggugacccgggagcccuacgugagcugcgaccccggcaagugcuaccaguucgcccuggggcagggcacgacccucgacaacaagcacuccaacgacaccauccacgaccgcaucccgcaccggacccugcugaugaacgagcucggcguccccuuccaccuggggacgcgccaggugugcguggccuggucguccagcuccugccacgacggcaaggcguggcugcacgucugcgugaccggggacgacaagaacgccaccgccucguucaucuacgacggccggcucguggacuccaucgggucguggucccagaacauccugcgcacccaggagagcgagugcgucugcaucaacggcacgugcaccguggugaugaccgacggcuccgccucggggcgggcggacacccgcauccuguucaucgaggagggcaagaucguccacaucagcccccucuccgggucggcccagcacguggaggagugcuccugcuacccccgguacccggacgugcgcugcaucugccgggacaacuggaagggcagcaaccgccccgucaucgacaucaacauggaggacuacuccaucgacucguccuacgugugcagcggccuggugggggacacgccccggaacgacgaccgcuccucgaacuccaacugccggaaccccaacaacgagcgcggcaacccgggggucaagggcugggccuucgacaacggggacgacguguggaugggccggaccaucucgaaggaccugcgcuccggcuacgagaccuucaaggucaucgggggcuggagcacccccaacuccaagucgcagaucaaccgccaggugaucguggacuccaacaacuggagcggguacuccggcaucuucucggucgagggcaagagcugcaucaaccggugcuucuacguggagcucauccgcgggcggcagcaggagacgcgcgugugguggaccuccaacucgaucgucguguucugcggcaccuccgggaccuacggcacggggagcuggcccgacggcgccaacaucaacuucaugcccaucuga

SEQ ID NO: 25596 - RNA, 1410 nt, Artificial Sequence
  derived and/or modified CDS sequence (AUadapt) from InfluenzaA__AFV53285__NA
augaaccccaaccagaagaucaucaccaucggcucggugucccugaccaucgccacggucugcuuccucaugcagaucgccauccuggcgaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccgaggugguggaguaccggaacuggucgaagccgcagugccagaucaccggguucgcccccuucuccaaggacaacagcauccgccuguccgccggcggggacaucugggucacgcgggagcccuacgugucgugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggcguggucguccucguccugccacgacgggaaggccuggcugcacgugugcgucaccggcgacgaccgcaacgccaccgccagcuucaucuacgacgggcggcucguggacuccaucggcucguggucccagaacauccugcgcacgcaggagucggagugcgugugcaucaacgggaccugcaccgucgugaugaccgacggcuccgcgagcggccgggccgacacgcgcauccuguucaucaaggaggggaagaucgugcacaucucgccccucuccggcucggcccagcacaucgaggagugcuccugcuacccccggcacccggacguccgcugcaucugccgggacaacuggaagggcucgaaccgccccgugaucaacaucaacauggaggacuacuccaucgacagcuccuacgugugcucggggcuggucggcgacacgccccggaacgacgacuccucguccaacagcaacugccgcgaccccaacaacgagcgggggaacccgggcgugaaggggugggccuucgacaacggcgacgacguguggaugggccgcaccaucaacaaggacucccggucgggguacgagaccuucaaggucaucggcgggugguccacccccaacucgaagucccaggugaaccgccaggucaucguggacaacaacaacuggucgggcuacuccgggaucuucagcguggagggcaagucgugcaucaaccggugcuucuacgucgagcugauccgcggccgcccccaggagacccgggugugguggaccuccaacucgaucguggucuucugcgggaccuccggcacguacgggaccggcagcuggcccgacggggccaacaucaacuucaugccgaucuga

SEQ ID NO: 25597 - RNA, 1410 nt, Artificial Sequence
  derived and/or modified CDS sequence (AUadapt) from InfluenzaA__AFV53296__NA
augaaccccaaccagaagaucaucaucaucggcucggugucccugaccaucgccaccgucugcuuccucaugcagaucgccauccuggugacgaccgugacccugcacuucaagcagcacgagugcgacucgccggcguccaaccaggucaugcccugcgagcccaucaucaucgagcgcaacaucaccgagaucguguaccucaacaacacgaccaucgagaaggagaucugccccgagguggucgaguaccggaacuggagcaagccgcagugccagaucaccggguucgcccccuucuccaaggacaacucgauccgccuguccgccggcggggacaucugggugacccgggagcccuacgugagcugcgaccccuccaagugcuaccaguucgcccugggccaggggacgacccucgacaacaagcacucgaacgacaccauccacgaccgcaucccgcaccggacccugcugaugaacgagcucggcguccccuuccaccugggcacgcgccaggugugcguggccugguccagcuccucgugccacgacgggaaggcguggcugcacgucugcgugaccggcgacgacaagaacgccaccgccuccuucaucuacgacgggcggcucguggacagcaucggcuccuggucgcagaacauccugcgcacccaggaguccgagugcgucugcaucaacgggacgugcaccguggugaugaccgacggcagcgccucgggccgggcggacacccgcauccuguucaucgaggaggggaagaucguccacaucagcccccucuccggcuccgcccagcacguggaggagugcucgugcuacccccgguacccggacgugcgcugcaucugccgggacaacuggaagggguccaaccgccccgucaucgacaucaacauggaggacuacagcaucgacuccucguacgugugcuccggccuggugggcgacacgccccggaacgacgaccgcagcuccaacucgaacugccgggaccccaacaacgagcgcgggaacccgggcgucaaggggugggccuucgacaacggcgacgacguguggauggggcggaccaucuccaaggaccugcgcagcggcuacgagaccuucaaggucaucggcgggugguccacccccaacucgaagucccagaucaaccgccaggugaucguggacagcaacaacugguccggcuacucggggaucuucagcgucgagggcaaguccugcaucaaccggugcuucuacguggagcucauccgcgggcggcagcaggagacgcgcgugugguggaccucgaacuccaucgucguguucugcggcaccagcggcaccuacgggacgggcuccuggcccgacggggccaacaucaacuucaugcccaucuga

SEQ ID NO: 25598 - RNA, 1410 nt, Artificial Sequence
  derived and/or modified CDS sequence (AUadapt) from InfluenzaA__AFV53307__NA
augaaccccaaccagaagaucaucaccaucggcucggugucccugaccaucgccacggucugcuuccucaugcagaucgccauccuggcgaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccgaggugguggaguaccggaacuggucgaagccgcagugccagaucaccggguucgcccccuucuccaaggacaacagcauccgccuguccgccggcggggacaucugggucacgcgggagcccuacgugucgugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggcguggucguccagcuccugccacgacgggaaggccuggcugcacgugugcgucaccggcgacgaccgcaacgccaccgccucguucaucuacgacgggcggcucguggacuccaucggcucguggucccagaacauccugcgcacgcaggagagcgagugcgugugcaucaacgggaccugcaccgucgugaugaccgacggcuccgcgucgggccgggccgacacgcgcauccuguucaucaaggaggggaagaucgugcacaucucgccccucuccggcagcgcccagcacgucgaggagugcuccugcuacccccgguacccggacgugcgcugcaucugccgggacaacuggaagggcucgaaccgccccgugaucgacaucaacauggaggacuacuccaucgacucguccuacgucugcagcgggcuggugggcgacacgccccggaacgacgacuccucguccaacucgaacugccgcgaccccaacaacgagcgggggaacccgggcgugaaggggugggccuucgacaacggcgacgacgucuggaugggccgcaccaucaacaaggacucccggagcggguacgagaccuucaaggugaucggcgggugguccacccccaacucgaagucccaggucaaccgccaggugaucguggacaacaacaacuggucgggcuacuccgggaucuucagcgucgagggcaagucgugcaucaaccggugcuucuacguggagcugauccgcggccgcccccaggagacccgggugugguggaccuccaacucgaucgucguguucugcgggaccuccggcacguacgggaccggcagcuggcccgacggggccaacaucaacuucaugccgaucuga

SEQ ID NO: 25599 - RNA, 1410 nt, Artificial Sequence
  derived and/or modified CDS sequence (AUadapt) from InfluenzaA__AFV53317__NA
augaaccccaaccagaagaucaucaccaucggcucggugucccugaccaucgccacggucugcuuccucaugcagaucgccauccuggcgaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccgaggugguggaguaccggaacuggucgaagccgcagugccagaucaccggguucgcccccuucuccaaggacaacagcauccgccuguccgccggcggggacaucugggucacgcgggagcccuacgugucgugcgaccccggcaagugcuaccaguucgcccuggggcagggcaccacccucgacaacaagcacuccaacggcaccauccacgaccgcucgccgcaccggacgcugcugaugaacgagcucggggugcccuuccaccugggcaccaagcaggucugcgcggccugguccucguccagcugccacgacgggaaggccuggcugcacgugugcgugaccggcgacgaccgcaacgccaccgcguccuucaucuacgacgggcggcucgucgacucgaucggcuccuggucgcagaacauccugcgcacgcaggaguccgagugcgugugcaucaacgggaccugcaccguggucaugaccgacggcagcgccucgggccgggccgacacgcgcauccuguucaucaaggaggggaagaucgugcacaucggcccccucuccggcucggcccagcacaucgaggagugcuccugcuacccccgguacccggacgugcgcugcaucugccgggacaacuggaaggggucgaaccgccccgucaucgacaucaacauggaggacuacuccaucgacagcuccuacgugugcucgggccuggugggggacacgccccggaacgacgacuccucguccaacagcaacugccgcgaccccaacaacgagcggggcaacccgggggucaagggcugggccuucgacaacggcgacgacguguggauggggcgcaccaucuccaaggaccugcggucgggcuacgagaccuucaaggugaucgggggcugguccacccccaacucgaagucccaggucaaccgccaggugaucgucgacaacaacaacuggucgggguacuccggcaucuucagcguggagggcaagucgugcaucaaccggugcuucuacguggagcucauccgcgggcgcccccaggagacccgggucugguggaccuccaacucgaucgugguguucugcggcaccuccgggacguacggcaccgggagcuggcccgacggcgcgaacaucaacuucaugccgaucuga

SEQ ID NO: 25600 - RNA, 1410 nt, Artificial Sequence
  derived and/or modified CDS sequence (AUadapt) from InfluenzaA__AFV53328__NA
augaaccccaaccagaagaucaucaccaucggcucggugucccugaccaucgccacggucugcuuccucaugcacaucgccauccuggcgaccaccgugacccugcacuucaagcagcacgagugcgacucgccggccuccaaccaggccaugcccugcgagcccaucaucaucgagcgcaacaucacggagaucguguaccucaacaacaccaccaucgagaaggagaucugccccgaggucguggaguaccggaacuggucgaagccgcagugccagaucaccggguucgcccccuucuccaaggacaacagcauccgccuguccgccggcggggacaucugggugacgcgggagcccuacgucucgugcgaccccggcaagugcuaccaguucgcgcuggggcagggcaccacccucgacaacaagcacuccaacggcaccauccacgaccgcaucccgcaccggacgcugcugaugaacgagcucggggugcccuuccaccugggcaccaagcaggucugcguggccuggucguccagcuccugccacgacgggaaggccuggcugcacgugugcaucaccggcgacgaccgcaacgccaccgcgucguucaucuacgacgggcggcucguggacuccaucggcucguggucccagaacauccugcgcacgcaggagagcgagugcgucugcaucaacgggaccugcaccguggugaugaccgacggcuccgccucgggccgggccgacacgcgcauccuguucaucaaggaggggaagaucguccacaucucgccccucuccggcagcgcccagcacaucgaggagugcuccugcuacccccgguacccggacgugcgcugcaucugccgggacaacuggaagggcucgaaccgccccgugaucgacaucaacauggaggacuacuccaucgacucguccuacgucugcagcgggcuggugggcgacacgccccggaacgacgacuccucguccaacucgaacugccgcgaccccaacaacgagcgggggaacccgggcgugaaggggugggccuucgacaacggcgacgacgucuggaugggccgcaccaucuccaaggaccugcggagcggguacgagaccuucaaggugaucggcgggugguccacccccaacucgaagucccaggugaaccgccaggucaucguggacaacaacaacuggucgggcuacuccgggaucuucagcgucgagggcaagucgugcaucaaccggugcuucuacguggagcucauccgcggccgcccccaggagacccgggugugguggaccuccaacucgaucgucguguucugcgggaccuccggcacguacgggaccggcagcuggcccgacggggcgaacaucaacuucaugccgaucuga

SEQ ID NO: 25601 - RNA, 1410 nt, Artificial Sequence
  derived and/or modified CDS sequence (AUadapt) from InfluenzaA__AFV53339__NA
augaaccccaaccagaagaucaucaccaucggcucggccucccugaccaucgccacggugugcuuccucaugcagaucgcgauccuggucaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccaaggugguggaguaccggaacuggucgaagccgcagugcaagaucaccggguucgcccccuucuccaaggacaacagcauccgccuguccgccggcggggacaucugggucacgcgggagcccuacgugucgugcgaccccggcaagugcuaccaguucgcccuggggcagggcaccacccucgacaacaagcacuccaacgacaccauccacgaccgcaucccgcaccggacgcugcugaugaacgagcucggcgugcccuuccaccuggggacccgccaggucugcaucgcguggucguccucguccugccacgacggcaaggccuggcugcacgugugcgugaccggggacgacaagaacgccaccgccagcuucaucuacgacggccggcucgucgacuccaucgggucguggucccagaacauccugcgcacgcaggagucggagugcgugugcaucaacgggaccugcaccguggucaugaccgacggcuccgcgagcgggcgggccgacacgcgcauccuguucaucgaggagggcaagaucgugcacaugucgccccucuccgggucggcccagcacguggaggagugcuccugcuacccccgguacccggacguccgcugcaucugccgggacaacuggaagggcucgaaccgccccgugguggacaucaacauggaggacuacuccaucgacagcuccuacgucugcucgggccuggugggggacacgccccggaacgacgaccgcuccucgaacuccaacugccggaaccccaacaacgagaagggcaaccagggggugaagggcugggccuucgacaacggggacgacgucuggaugggccgcaccaucagcaaggaccugcgguccggcuacgagaccuucaaggugaucgggggcuggucgaccccgaacuccaagucgcagaucaaccgccaggucaucguggacuccgacaaccggucgggguacuccggcaucuucagcguggagggcaagucgugcaucaaccgcugcuucuacgucgagcucauccgcggccggaagcaggagacccgcgugugguggaccuccaacucgaucguggucuucugcggcaccuccgggacguacggcaccgggagcuggcccgacggcgccaacaucaaccugaugcccaucuga

SEQ ID NO: 25602 - RNA, 1410 nt, Artificial Sequence; identical to SEQ ID NO: 16318
  derived and/or modified CDS sequence (AUadapt) from InfluenzaA__AFX96367__NA

SEQ ID NO: 25603 - RNA, 1410 nt, Artificial Sequence; identical to SEQ ID NO: 16318
  derived and/or modified CDS sequence (AUadapt) from InfluenzaA__AFX96386__NA

SEQ ID NO: 25604 - RNA, 1410 nt, Artificial Sequence; identical to SEQ ID NO: 19494
  derived and/or modified CDS sequence (AUadapt) from InfluenzaA__AFX96401__NA

SEQ ID NO: 25605 - RNA, 1410 nt, Artificial Sequence; identical to SEQ ID NO: 19494
  derived and/or modified CDS sequence (AUadapt) from InfluenzaA__AFX96411__NA

SEQ ID NO: 25606 - RNA, 1410 nt, Artificial Sequence; identical to SEQ ID NO: 19494
  derived and/or modified CDS sequence (AUadapt) from InfluenzaA__AFX96421__NA

SEQ ID NO: 25607 - RNA, 1410 nt, Artificial Sequence; identical to SEQ ID NO: 19494
  derived and/or modified CDS sequence (AUadapt) from InfluenzaA__AFX96431__NA

SEQ ID NO: 25608 - RNA, 1410 nt, Artificial Sequence; identical to SEQ ID NO: 19494
  derived and/or modified CDS sequence (AUadapt) from InfluenzaA__AFX96441__NA

SEQ ID NO: 25609 - RNA, 1410 nt, Artificial Sequence; identical to SEQ ID NO: 19494
  derived and/or modified CDS sequence (AUadapt) from InfluenzaA__AFX96451__NA

SEQ ID NO: 25610 - RNA, 1410 nt, Artificial Sequence; identical to SEQ ID NO: 19494
  derived and/or modified CDS sequence (AUadapt) from InfluenzaA__AFX96461__NA

SEQ ID NO: 25611 - RNA, 1410 nt, Artificial Sequence; identical to SEQ ID NO: 16318
  derived and/or modified CDS sequence (AUadapt) from InfluenzaA__AFX96471__NA

SEQ ID NO: 25612 - RNA, 1410 nt, Artificial Sequence; identical to SEQ ID NO: 16318
  derived and/or modified CDS sequence (AUadapt) from InfluenzaA__AFX96481__NA

SEQ ID NO: 25613 - RNA, 1410 nt, Artificial Sequence; identical to SEQ ID NO: 16318
  derived and/or modified CDS sequence (AUadapt) from InfluenzaA__AFX96491__NA

SEQ ID NO: 25614 - RNA, 1410 nt, Artificial Sequence; identical to SEQ ID NO: 16318
  derived and/or modified CDS sequence (AUadapt) from InfluenzaA__AFX96501__NA

SEQ ID NO: 25615 - RNA, 1410 nt, Artificial Sequence; identical to SEQ ID NO: 16318
  derived and/or modified CDS sequence (AUadapt) from InfluenzaA__AFX96511__NA

SEQ ID NO: 25616 - RNA, 1410 nt, Artificial Sequence
  derived and/or modified CDS sequence (AUadapt) from InfluenzaA__AFX96521__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgcgccagagcgucguguccgugaagcuggccggcaacucgucccucugcccggucagcgggugggccaucuacuccaaggacaacagcauccggaucggcuccaagggcgacguguucgugauccgcgagcccuucaucagcugcagcccccuggagugccggaccuucuuccugacccagggggcccuccugaacgacaagcacuccaacggcaccaucaaggaccgcucccccuaccggacgcugaugucgugcccgaucggggagguccccucccccuacaacagccgcuucgagagcguggccugguccgcgagcgccugccacgacggcaucaacuggcucaccaucgggaucuccggccccgacaacggcgccguggccguccugaaguacaacgggaucaucaccgacaccaucaagagcuggcggaacaacauccugcgcacgcaggaguccgagugcgcgugcgugaacggcucgugcuucaccgugaugaccgacgggccguccgacggccaggccagcuacaagaucuuccggaucgagaagggcaagaucgucaaguccguggagaugaacgcccccaacuaccacuacgaggagugcagcugcuaccccgacuccagcgagaucacgugcgugugccgcgacaacuggcacggguccaaccggcccugggucucguucaaccagaaccucgaguaccagaucggcuacaucugcuccgggaucuucggcgacaacccgcgccccaacgacaagaccgggagcugcggccccguguccagcaacggcgccaacggggugaagggcuucuccuucaaguacgggaacggcgucuggaucgggcggaccaagagcaucagcucccgcaacggcuucgagaugaucugggaccccaacggcuggaccgggaccgacaacaacuucucgaucaagcaggacaucgugggcaucaacgagugguccggguacagcggcuccuucgugcagcacccggagcugacggggcuggacugcauccggcccugcuucugggucgagcucauccgcggccggcccaaggagaacaccaucuggaccagcggcuccagcaucuccuucugcggggugaacagcgacaccgucggcugguccuggcccgacggggccgagcugccguucacgaucgacaaguga

SEQ ID NO: 25617 - RNA, 1410 nt, Artificial Sequence; identical to SEQ ID NO: 16318
  derived and/or modified CDS sequence (AUadapt) from InfluenzaA__AFX96531__NA

SEQ ID NO: 25618 - RNA, 1410 nt, Artificial Sequence; identical to SEQ ID NO: 16318
  derived and/or modified CDS sequence (AUadapt) from InfluenzaA__AFX96541__NA

SEQ ID NO: 25619 - RNA, 1410 nt, Artificial Sequence; identical to SEQ ID NO: 16318
  derived and/or modified CDS sequence (AUadapt) from InfluenzaA__AFX96551__NA

SEQ ID NO: 25620 - RNA, 1410 nt, Artificial Sequence; identical to SEQ ID NO: 23664
  derived and/or modified CDS sequence (AUadapt) from InfluenzaA__AFX96561__NA

SEQ ID NO: 25621 - RNA, 1410 nt, Artificial Sequence; identical to SEQ ID NO: 16318
  derived and/or modified CDS sequence (AUadapt) from InfluenzaA__AFX96571__NA

SEQ ID NO: 25622 - RNA, 1410 nt, Artificial Sequence; identical to SEQ ID NO: 16318
  derived and/or modified CDS sequence (AUadapt) from InfluenzaA__AFX96581__NA

SEQ ID NO: 25623 - RNA, 1410 nt, Artificial Sequence; identical to SEQ ID NO: 16318
  derived and/or modified CDS sequence (AUadapt) from InfluenzaA__AFX96591__NA

SEQ ID NO: 25624 - RNA, 1410 nt, Artificial Sequence; identical to SEQ ID NO: 16318
  derived and/or modified CDS sequence (AUadapt) from InfluenzaA__AFX96601__NA

SEQ ID NO: 25625 - RNA, 1410 nt, Artificial Sequence; identical to SEQ ID NO: 16318
  derived and/or modified CDS sequence (AUadapt) from InfluenzaA__AFX96611__NA

SEQ ID NO: 25626 - RNA, 1410 nt, Artificial Sequence; identical to SEQ ID NO: 16318
  derived and/or modified CDS sequence (AUadapt) from InfluenzaA__AFX96621__NA

SEQ ID NO: 25627 - RNA, 1410 nt, Artificial Sequence; identical to SEQ ID NO: 16318
  derived and/or modified CDS sequence (AUadapt) from InfluenzaA__AFX96631__NA

SEQ ID NO: 25628 - RNA, 1410 nt, Artificial Sequence
  derived and/or modified CDS sequence (AUadapt) from InfluenzaA__AFX96641__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagcaaguucgagagcguggccugguccgcgagcgccugccacgacgggaucaacuggcucaccaucggcaucuccggccccgacaacggggccguggccguccugaaguacaacggcaucaucaccgacaccaucaagagcuggcggaacaacauccugcgcacgcaggaguccgagugcgcgugcgugaacgggucgugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucucguucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 25629 - RNA, 1410 nt, Artificial Sequence; identical to SEQ ID NO: 16318
  derived and/or modified CDS sequence (AUadapt) from InfluenzaA__AFX96651__NA

SEQ ID NO: 25630 - RNA, 1410 nt, Artificial Sequence; identical to SEQ ID NO: 16318
  derived and/or modified CDS sequence (AUadapt) from InfluenzaA__AFX96661__NA

SEQ ID NO: 25631 - RNA, 1410 nt, Artificial Sequence; identical to SEQ ID NO: 16318
  derived and/or modified CDS sequence (AUadapt) from InfluenzaA__AFX96671__NA

SEQ ID NO: 25632 - RNA, 1410 nt, Artificial Sequence; identical to SEQ ID NO: 16318
  derived and/or modified CDS sequence (AUadapt) from InfluenzaA__AFX96681__NA

SEQ ID NO: 25633 - RNA, 1410 nt, Artificial Sequence; identical to SEQ ID NO: 16318
  derived and/or modified CDS sequence (AUadapt) from InfluenzaA__AFX96691__NA

SEQ ID NO: 25634 - RNA, 1410 nt, Artificial Sequence
  derived and/or modified CDS sequence (AUadapt) from InfluenzaA__AFX96701__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcaucaucaccuacgagaacaacaccugggucaaccagaccuacgugaacaucuccaacacgaacuucgccgcgggccagagcguggucuccgugaagcuggccgggaacagcucccucugcccggugagcggcugggccaucuacuccaaggacaacucgauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagucguggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccuucaacggggccaacggcgugaagggguucucguucaaguacggcaacgggguguggaucggccgcaccaaguccaucagcagccggaacggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcaucaucuccuucugcggcgucaacagcgacaccguggggugguccuggcccgacggcgccgagcugccguucacgaucgacaaguga

SEQ ID NO: 25635 - RNA, 1410 nt, Artificial Sequence; identical to SEQ ID NO: 16318
  derived and/or modified CDS sequence (AUadapt) from InfluenzaA__AFX96711__NA

SEQ ID NO: 25636 - RNA, 1410 nt, Artificial Sequence
  derived and/or modified CDS sequence (AUadapt) from InfluenzaA__AFX96721__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccguguggaccagcggguccagcaucuccuucugcggcgucaacagcgacaccguggggugguccuggcccgacggcgccgagcugccguucacgaucgacaaguga

SEQ ID NO: 25637 - RNA, 1410 nt, Artificial Sequence; identical to SEQ ID NO: 25636
  derived and/or modified CDS sequence (AUadapt) from InfluenzaA__AFX96731__NA

SEQ ID NO: 25638 - RNA, 1410 nt, Artificial Sequence; identical to SEQ ID NO: 16318
  derived and/or modified CDS sequence (AUadapt) from InfluenzaA__AFX96741__NA

SEQ ID NO: 25639 - RNA, 1410 nt, Artificial Sequence; identical to SEQ ID NO: 16318
  derived and/or modified CDS sequence (AUadapt) from InfluenzaA__AFX96751__NA

SEQ ID NO: 25640 - RNA, 1410 nt, Artificial Sequence; identical to SEQ ID NO: 20158
  derived and/or modified CDS sequence (AUadapt) from InfluenzaA__AFX96761__NA

SEQ ID NO: 25641 - RNA, 1410 nt, Artificial Sequence; identical to SEQ ID NO: 16318
  derived and/or modified CDS sequence (AUadapt) from InfluenzaA__AFX96771__NA

SEQ ID NO: 25642 - RNA, 1410 nt, Artificial Sequence
  derived and/or modified CDS sequence (AUadapt) from InfluenzaA__AFX96791__NA
augaaccccaaccagaagaucaucaccaucggcucggugugcaugaccaucgggauggccaaccugauccuccaggucggcaacaucaucuccaucuggaucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacucgucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcaucaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 25643 - RNA, 1410 nt, Artificial Sequence; identical to SEQ ID NO: 25642
  derived and/or modified CDS sequence (AUadapt) from InfluenzaA__AFX96801__NA

SEQ ID NO: 25644 - RNA, 1410 nt, Artificial Sequence
  derived and/or modified CDS sequence (AUadapt) from InfluenzaA__AFX96811__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugcgccuggccgggaacucgucccucugcccggucagcggcugggccaucuacuccaaggacaacagcauccggaucggcuccaagggggacguguucgugauccgcgagcccuucaucagcugcagcccccuggagugccggaccuucuuccugacccagggcgcccuccugaacgacaagcacuccaacgggaccaucaaggaccgcucccccuaccggacgcugaugucgugcccgaucggcgagguccccucccccuacaacagccgcuucgagagcguggccugguccgcgagcgccugccacgacgggaucaacuggcucaccaucggcaucuccggccccgacaacggggccguggccguccugaaguacaacggcaucaucaccgacaccaucaagagcuggcggaacaacauccugcgcacgcaggaguccgagugcgcgugcgugaacgggucgugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucucguucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 25645 - RNA, 1410 nt, Artificial Sequence; identical to SEQ ID NO: 16318
  derived and/or modified CDS sequence (AUadapt) from InfluenzaA__AFX96821__NA

SEQ ID NO: 25646 - RNA, 1410 nt, Artificial Sequence; identical to SEQ ID NO: 25642
  derived and/or modified CDS sequence (AUadapt) from InfluenzaA__AFX96831__NA

SEQ ID NO: 25647 - RNA, 1410 nt, Artificial Sequence
  derived and/or modified CDS sequence (AUadapt) from InfluenzaA__AFX96841__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugcgccuggccgggaacagcucccucugcccggucucgggcugggccaucuacuccaaggacaacagcauccggaucggcuccaagggggacguguucgugauccgcgagcccuucaucagcugcagcccccuggagugccggaccuucuuccugacccagggcgcccuccugaacgacaagcacuccaacgggaccaucaaggaccgcucccccuaccggacgcugaugagcugcccgaucggcgagguccccucccccuacaacagccgcuucgagucgguggccugguccgcgagcgccugccacgacgggaucaacuggcucaccaucggcaucuccggccccgacaacggggccguggccguccugaaguacaacggcaucaucaccgacaccaucaagagcuggcggaacaacauccugcgcacgcaggaguccgagugcgcgugcgugaacgggagcugcuucaccgugaugaccgacggcccguccgacggccaggccagcuacaagaucuuccggaucgagaaggggaagaucgucaaguccguggagaugaacgcccccaacuacuacuacgaggagugcucgugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucucgucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 25648 - RNA, 1410 nt, Artificial Sequence; identical to SEQ ID NO: 16318
  derived and/or modified CDS sequence (AUadapt) from InfluenzaA__AFX96859__NA

SEQ ID NO: 25649 - RNA, 1410 nt, Artificial Sequence; identical to SEQ ID NO: 16318
  derived and/or modified CDS sequence (AUadapt) from InfluenzaA__AFX96907__NA

SEQ ID NO: 25650 - RNA, 1410 nt, Artificial Sequence; identical to SEQ ID NO: 16318
  derived and/or modified CDS sequence (AUadapt) from InfluenzaA__AFX96917__NA

SEQ ID NO: 25651 - RNA, 1410 nt, Artificial Sequence; identical to SEQ ID NO: 16318
  derived and/or modified CDS sequence (AUadapt) from InfluenzaA__AFX96927__NA

SEQ ID NO: 25652 - RNA, 1410 nt, Artificial Sequence
  derived and/or modified CDS sequence (AUadapt) from InfluenzaA__AFX96937__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccagcacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 25653 - RNA, 1410 nt, Artificial Sequence; identical to SEQ ID NO: 16274
  derived and/or modified CDS sequence (AUadapt) from InfluenzaA__AFY23991__NA

SEQ ID NO: 25654 - RNA, 1410 nt, Artificial Sequence; identical to SEQ ID NO: 16318
  derived and/or modified CDS sequence (AUadapt) from InfluenzaA__AFY24001__NA

SEQ ID NO: 25655 - RNA, 1410 nt, Artificial Sequence; identical to SEQ ID NO: 16318
  derived and/or modified CDS sequence (AUadapt) from InfluenzaA__AFY24022__NA

SEQ ID NO: 25656 - RNA, 1410 nt, Artificial Sequence; identical to SEQ ID NO: 16318
  derived and/or modified CDS sequence (AUadapt) from InfluenzaA__AFY24043__NA

SEQ ID NO: 25657 - RNA, 1410 nt, Artificial Sequence
  derived and/or modified CDS sequence (AUadapt) from InfluenzaA__AFY24153__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaccgacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcacguccgggaccuacggcaccgggagcuggccggacggcgccgacaucaaccugaugcccaucuga

SEQ ID NO: 25658 - RNA, 1410 nt, Artificial Sequence
  derived and/or modified CDS sequence (AUadapt) from InfluenzaA__AFY24208__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacaaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacgagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagcgccugcgguccggcuacgagaccuucaaggucaucgagggguggagcaaccccaacuccaagcugcagaucaaccgccaggugaucguggaccggggcaaccgcucgggguacuccggcaucuucagcgucgagggcaagucgugcaucaaccggugcuucuacguggagcucauccgcgggcggaagcaggagaccgaggugcuguggaccuccaacagcaucgucguguucugcggcaccuccgggacguacggcaccgggagcuggccggacggcgccgacaucaaccugaugcccaucuga

SEQ ID NO: 25659 - RNA, 1410 nt, Artificial Sequence; identical to SEQ ID NO: 18331
  derived and/or modified CDS sequence (AUadapt) from InfluenzaA__AFY24219__NA

SEQ ID NO: 25660 - RNA, 1410 nt, Artificial Sequence
  derived and/or modified CDS sequence (AUadapt) from InfluenzaA__AGB12978__NA
augaaccccaaccagcgcaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgcggcagagcgucguguccgugaagcuggccggcaacucgucccucugcccggucagcgggugggccaucuacuccaaggacaacagcauccgcaucggcuccaagggcgacguguucgugauccgggagcccuucaucagcugcagcccccuggagugccgcaccuucuuccugacccagggggcccuccugaacgacaagcacuccaacggcaccaucaaggaccggucccccuaccgcacgcugaugucgugcccgaucggggagguccccucccccuacaacagccgguucgagagcguggccugguccgcgagcgccugccacgacggcaucaacuggcucaccaucgggaucuccggccccgacaacggcgccguggccguccugaaguacaacgggaucaucaccgacaccaucaagagcuggcgcaacaacauccugcggacgcaggaguccgagugcgcgugcgugaacggcucgugcuucaccaucaugaccgacgggccguccgacggccaggccagcuacaagaucuuccgcaucgagaagggcaagaucgugaaguccgucgagaugaacgcccccaacuaccacuacgaggagugcagcugcuaccccgacuccagcgagaucacgugcgugugccgggacaacuggcacggguccaaccgccccugggugucguucaaccagaaccucgaguaccagaucggcuacaucugcuccgggaucuucggcgacaacccgcggcccaacgacaagaccgggagcugcggccccgucuccagcaacggcgccaacggggugaagggcuucuccuucaaguacgggaacggcguguggaucgggcgcaccaagagcaucagcucccggaagggcuucgagaugaucugggaccccaacggcuggaccgggaccgacaacaacuucucgaucaagcaggacaucgucggcaucaacgagugguccggguacagcggcuccuucgugcagcacccggagcugacggggcuggacugcauccgccccugcuucuggguggagcucauccggggccgccccaaggagaacaccaucuggaccagcggcuccagcaucuccuucugcggggucaacagcgacaccgugggcugguccuggcccgacggggccgagcugccguucacgaucgacaaguga

SEQ ID NO: 25661 - RNA, 1410 nt, Artificial Sequence; identical to SEQ ID NO: 22659
  derived and/or modified CDS sequence (AUadapt) from InfluenzaA__AGB12989__NA

SEQ ID NO: 25662 - RNA, 1410 nt, Artificial Sequence; identical to SEQ ID NO: 23111
  derived and/or modified CDS sequence (AUadapt) from InfluenzaA__AGB13009__NA

SEQ ID NO: 25663 - RNA, 1410 nt, Artificial Sequence; identical to SEQ ID NO: 23111
  derived and/or modified CDS sequence (AUadapt) from InfluenzaA__AGB13019__NA

SEQ ID NO: 25664 - RNA, 1410 nt, Artificial Sequence; identical to SEQ ID NO: 23111
  derived and/or modified CDS sequence (AUadapt) from InfluenzaA__AGB13029__NA

SEQ ID NO: 25665 - RNA, 1410 nt, Artificial Sequence; identical to SEQ ID NO: 23360
  derived and/or modified CDS sequence (AUadapt) from InfluenzaA__AGB13039__NA

SEQ ID NO: 25666 - RNA, 1410 nt, Artificial Sequence; identical to SEQ ID NO: 23111
  derived and/or modified CDS sequence (AUadapt) from InfluenzaA__AGB13051__NA

SEQ ID NO: 25667 - RNA, 1410 nt, Artificial Sequence
  derived and/or modified CDS sequence (AUadapt) from InfluenzaA__AGB13069__NA
augaaccccaaccagaagaucaucaccaucggcucgaucugcaugaccaucgggauggccaaccugauccuccagaucggcaacaucaucuccaucuggaucagccacuccauccagcuggggaaccagaaccagaucgagacgugcaaccagagcgugaucaccuacgagaacaacaccugggucaaccagaccuacgugaacaucuccaacacgaacuucgccgcgggccagagcguggucuccgugaagcuggccgggaacucgucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggucgugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccuggaucucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 25668 - RNA, 1410 nt, Artificial Sequence
  derived and/or modified CDS sequence (AUadapt) from InfluenzaA__AGB13074__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucgccuccgugaagcuggccgggaacucgucccucugcccggugagcggcugggccaucuacuccaaggacaacagcguccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggcgugguccgccucggccugccacgacgggaucaacuggcucaccaucggcaucuccggccccgacaacggggccguggcgguccugaaguacaacggcaucaucaccgacaccaucaagagcuggcgcaacaacauccugcggacgcaggaguccgagugcgccugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgcggagcugccguucacgaucgacaaguga

SEQ ID NO: 25669 - RNA, 1410 nt, Artificial Sequence
  derived and/or modified CDS sequence (AUadapt) from InfluenzaA__AGB13115__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugcugcgggagcccuucaucagcugcagcccccuggagugccgcaccuucuuccucacccagggcgcccugcugaacgacaagcacuccaacgggaccaucaaggaccggucccccuaccgcacgcucaugucgugcccgaucggcgagguccccucccccuacaacagccgguucgagagcguggccugguccgcgagcgccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggucgugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcgcggcuccaaccggcccugggugucguucaaccagaaccuggaguaccagaucggguacaucugcuccggcaucuucggggacaacccgcgccccaacgacaagaccggcagcugcggccccgucuccagcaacggggccaacggcgugaagggguucuccuucaaguacggcaacgggguguggaucggccggaccaagagcaucagcucccgcaagggcuucgagaugaucugggaccccaacggguggaccggcaccgacaacaacuucucgaucaagcaggacaucgucgggaucaacgagugguccggcuacagcggguccuucgugcagcacccggagcugacgggccucgacugcauccggcccugcuucuggguggagcugauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 25670 - RNA, 1410 nt, Artificial Sequence; identical to SEQ ID NO: 23111
  derived and/or modified CDS sequence (AUadapt) from InfluenzaA__AGB13133__NA

SEQ ID NO: 25671 - RNA, 1410 nt, Artificial Sequence; identical to SEQ ID NO: 22659
  derived and/or modified CDS sequence (AUadapt) from InfluenzaA__AGB13152__NA

SEQ ID NO: 25672 - RNA, 1410 nt, Artificial Sequence; identical to SEQ ID NO: 22659
  derived and/or modified CDS sequence (AUadapt) from InfluenzaA__AGB13162__NA

SEQ ID NO: 25673 - RNA, 1410 nt, Artificial Sequence; identical to SEQ ID NO: 23482
  derived and/or modified CDS sequence (AUadapt) from InfluenzaA__AGB13173__NA

SEQ ID NO: 25674 - RNA, 1410 nt, Artificial Sequence
  derived and/or modified CDS sequence (AUadapt) from InfluenzaA__AGB13183__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccaggacaacggggccguggccguccugaaguacaacggcaucaucaccgacaccaucaagagcuggcgcaacaacauccugcggacgcaggaguccgagugcgcgugcgugaacgggucgugcuucaccaucaugaccgacggccccuccgacggccaggccagcuacaagaucuuccgcaucgagaaggggaagaucgugaaguccgucgagaugaacgccccgaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccccggccgaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucucgaucaagcaggacaucgucgggaucaacgagugguccggcuacagcggguccuucgugcagcaccccgagcugacgggccuggacugcauccgcccgugcuucuggguggagcucauccggggccgccccaaggagaacaccaucuggaccagcggguccagcaucuccuucugcggcgucaacagcgacaccguggggugguccuggcccgacggcgccgagcugcccuucacgaucgacaaguga

SEQ ID NO: 25675 - RNA, 1410 nt, Artificial Sequence; identical to SEQ ID NO: 23111
  derived and/or modified CDS sequence (AUadapt) from InfluenzaA__AGB13193__NA

SEQ ID NO: 25676 - RNA, 1410 nt, Artificial Sequence; identical to SEQ ID NO: 23178
  derived and/or modified CDS sequence (AUadapt) from InfluenzaA__AGB13203__NA

SEQ ID NO: 25677 - RNA, 1410 nt, Artificial Sequence; identical to SEQ ID NO: 23111
  derived and/or modified CDS sequence (AUadapt) from InfluenzaA__AGB13213__NA

SEQ ID NO: 25678 - RNA, 1410 nt, Artificial Sequence; identical to SEQ ID NO: 23111
  derived and/or modified CDS sequence (AUadapt) from InfluenzaA__AGB13223__NA

SEQ ID NO: 25679 - RNA, 1410 nt, Artificial Sequence; identical to SEQ ID NO: 23111
  derived and/or modified CDS sequence (AUadapt) from InfluenzaA__AGB13233__NA

SEQ ID NO: 25680 - RNA, 1410 nt, Artificial Sequence
  derived and/or modified CDS sequence (AUadapt) from InfluenzaA__AGB13243__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagcgggggaagaucgugaaguccgucgagaugaacgcccccaacuacuacuacgaggagugcucgugcuaccccgacuccagcgagaucacgugcgugugccgcgacaacuggcacggcuccaaccggcccugggugagcuucaaccagaaccucgaguaccagaucggguacaucugcuccggcgucuucggggacaacccgcgccccaacgacaagaccggcagcugcggccccguguccagcaacggggccaacggcgugaagggguucuccuucaaguacggcaacggggucuggaucggccggaccaagagcaucucgucccgcaagggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 25681 - RNA, 1410 nt, Artificial Sequence; identical to SEQ ID NO: 23178
  derived and/or modified CDS sequence (AUadapt) from InfluenzaA__AGB13253__NA

SEQ ID NO: 25682 - RNA, 1410 nt, Artificial Sequence
  derived and/or modified CDS sequence (AUadapt) from InfluenzaA__AGB13263__NA
augaaccccaaccagaagaucaucaccaucggcucggugugcaugaccaucgggauggccaaccugauccuccagaucggcaacaucaucuccaucuggaucagccacuccauccagcuggggaaccagaaccagacggagaccugcaaccagagcgucaucaccuacgagaacaacaccugggugaaccagacguacgugaacaucuccaacaccaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaaggcccccaacuaccacuacgaggagugcucgugcuaccccgacuccagcgagaucacgugcgugugccgggacaacuggcacggcuccaaccgccccugggucagcuucaaccagaaccucgaguaccggaucggguacaucugcuccggcaucuucggggacaacccgcgccccaacgacaagaccggcagcugcggccccguguccucgaacggggccaacggcgugaagggguucuccuucaaguacggcaacggggucuggaucggccggaccaagagcaucagcucccgcaacggcuucgagaugaucugggaccccaacggguggaccggcacggacaacaacuucagcaucaagcaggacaucaucgggaucaacgagugguccggcuacucgggguccuucgugcagcacccggagcugaccggccuggacugcauccggcccugcuucuggguggagcucauccgcggccggcccaaggagaacaccaucuggaccagcggguccagcaucuccuucugcggcgucaacagcgacacgguggggugguccuggcccgacggcgccgagcugccguucaccgucgacaaguga

SEQ ID NO: 25683 - RNA, 1410 nt, Artificial Sequence; identical to SEQ ID NO: 23111
  derived and/or modified CDS sequence (AUadapt) from InfluenzaA__AGB13273__NA

SEQ ID NO: 25684 - RNA, 1410 nt, Artificial Sequence
  derived and/or modified CDS sequence (AUadapt) from InfluenzaA__AGB13283__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggcgcggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 25685 - RNA, 1410 nt, Artificial Sequence; identical to SEQ ID NO: 23111
  derived and/or modified CDS sequence (AUadapt) from InfluenzaA__AGB13293__NA

SEQ ID NO: 25686 - RNA, 1410 nt, Artificial Sequence; identical to SEQ ID NO: 23111
  derived and/or modified CDS sequence (AUadapt) from InfluenzaA__AGB13303__NA

SEQ ID NO: 25687 - RNA, 1410 nt, Artificial Sequence
  derived and/or modified CDS sequence (AUadapt) from InfluenzaA__AGB13313__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgccaagcuggccgggaacucgucccucugcccggugagcggcugggccaucuacuccaaggacaacagcauccgcaucggcuccaagggggacgucuucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgcgugguccgccucggccugccacgacgggaucaacuggcucaccaucggcaucuccggccccgacaacggggccguggcggugcugaaguacaacggcaucaucaccgacaccaucaagagcuggcgcaacaacauccugcggacgcaggaguccgagugcgccugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaagggcagcugcggccccgucuccucgaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacucgggguccuucgugcagcacccggagcugaccggccuggacugcauccgccccugcuucuggguggagcucauccggggccgccccaaggagaacacgaucuggaccagcggguccagcaucuccuucugcggcgucaacagcgacaccguggggugguccuggcccgacggcgcggagcugccguucaccaucgacaaguga

SEQ ID NO: 25688 - RNA, 1410 nt, Artificial Sequence; identical to SEQ ID NO: 23111
  derived and/or modified CDS sequence (AUadapt) from InfluenzaA__AGB13323__NA

SEQ ID NO: 25689 - RNA, 1410 nt, Artificial Sequence
  derived and/or modified CDS sequence (AUadapt) from InfluenzaA__AGB13333__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgccgucucggugaagcuggccgggaacuccagccucugcccgguguccggcugggccaucuacagcaaggacaacuccauccgcaucggcagcaagggggacgucuucgugauccgggagcccuucaucuccugcucgccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccgucgcguggucggccuccgccugccacgacgggaucaacuggcucaccaucggcaucagcggccccgacaacggggccguggcggugcugaaguacaacggcaucaucaccgacaccaucaaguccuggcgcaacaacauccugcggacgcaggagagcgagugcgccugcgucaacggguccugcuucaccaucaugaccgacggcccgagcgacggccaggccuccuacaagaucuuccgcaucgagaaggggaagaucgucaagucgguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgugucguccaacggggccaacggcgucaagggguucagcuucaaguacggcaacgggguguggaucggccgcaccaagagcaucuccagccggaagggcuucgagaugaucugggaccccaacggguggaccggcaccgacaacaacuucuccaucaagcaggacaucguggggaucaacgaguggucgggcuacuccgggagcuucguccagcacccggagcugacgggccuggacugcauccgccccugcuucuggguggagcucauccggggccgccccaaggagaacaccaucuggaccuccgggagcuccaucagcuucugcggcgugaacuccgacaccgucggguggagcuggcccgacggcgcggagcugccguucacgaucgacaaguga

SEQ ID NO: 25690 - RNA, 1410 nt, Artificial Sequence; identical to SEQ ID NO: 23111
  derived and/or modified CDS sequence (AUadapt) from InfluenzaA__AGB13343__NA

SEQ ID NO: 25691 - RNA, 1410 nt, Artificial Sequence; identical to SEQ ID NO: 23360
  derived and/or modified CDS sequence (AUadapt) from InfluenzaA__AGB13353__NA

SEQ ID NO: 25692 - RNA, 1410 nt, Artificial Sequence
  derived and/or modified CDS sequence (AUadapt) from InfluenzaA__AGB13363__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucgccuccgugaagcuggccgggaacucgucccucugcagcguguccggcugggccaucuacagcaaggacaacuccauccgcaucggcagcaagggggacgucuucgugauccgggagccguucaucuccugcucgccccuggagugccgcaccuucuuccugacccagggcgcccuccugaacgacaagcacuccaacgggaccaucaaggaccggagccccuaccgcacgcugauguccugccccaucggcgaggugccgagccccuacaacagccgguucgaguccgucgcguggucggccuccgccugccacgacgggaucaacuggcucaccaucggcaucagcggccccgacaacggggccguggcggugcugaaguacaacggcaucaucaccgacaccaucaaguccuggcgcaacaacauccugcggacgcaggagagcgagugcgccugcgucaacggguccugcuucaccaucaugaccgacggccccagcgacggccaggccuccuacaagaucuuccgcaucgagaaggggaagaucgucaagucgguggagaugaacgccccgaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccccggccgaacgacaagaccggcuccugcggccccgugucguccaacggggccaacggcgucaagggguucagcuucaaguacggcaacgggguguggaucggccgcaccaagagcaucuccagccggaagggcuucgagaugaucugggaccccaacggguggaccggcaccgacaacaacuucuccaucaagcaggacaucguggggaucaacgaguggucgggcuacuccgggagcuucguccagcaccccgagcugacgggccuggacugcauccgcccgugcuucuggguggagcucauccggggccgccccaaggagaacaccaucuggaccuccgggagcuccaucagcuucugcggcgugaacuccgacaccgucggguggagcuggcccgacggcgcggagcugcccuucacgaucgacaaguga

SEQ ID NO: 25693 - RNA, 1410 nt, Artificial Sequence
  derived and/or modified CDS sequence (AUadapt) from InfluenzaA__AGB13383__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcucgugcggccccgucuccagcaacggggccaacggcgugaagggguucuccuucaaguacggcagcgggguguggaucggccgcaccaagagcaucuccagccggaagggcuucgagaugaucugggaccccaacggguggaccggcaccgacaacaacuucuccaucaagcaggacaucgucgggaucaacgaguggucgggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 25694 - RNA, 1410 nt, Artificial Sequence; identical to SEQ ID NO: 22659
  derived and/or modified CDS sequence (AUadapt) from InfluenzaA__AGB13393__NA

SEQ ID NO: 25695 - RNA, 1410 nt, Artificial Sequence; identical to SEQ ID NO: 23359
  derived and/or modified CDS sequence (AUadapt) from InfluenzaA__AGB13403__NA

SEQ ID NO: 25696 - RNA, 1410 nt, Artificial Sequence; identical to SEQ ID NO: 22659
  derived and/or modified CDS sequence (AUadapt) from InfluenzaA__AGB13413__NA

SEQ ID NO: 25697 - RNA, 1410 nt, Artificial Sequence; identical to SEQ ID NO: 22659
  derived and/or modified CDS sequence (AUadapt) from InfluenzaA__AGB13423__NA

SEQ ID NO: 25698 - RNA, 1410 nt, Artificial Sequence; identical to SEQ ID NO: 23359
  derived and/or modified CDS sequence (AUadapt) from InfluenzaA__AGB13433__NA

SEQ ID NO: 25699 - RNA, 1410 nt, Artificial Sequence; identical to SEQ ID NO: 23359
  derived and/or modified CDS sequence (AUadapt) from InfluenzaA__AGB13443__NA

SEQ ID NO: 25700 - RNA, 1410 nt, Artificial Sequence
  derived and/or modified CDS sequence (AUadapt) from InfluenzaA__AGB13453__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucgcgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcuucuccucgcggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 25701 - RNA, 1410 nt, Artificial Sequence; identical to SEQ ID NO: 22659
  derived and/or modified CDS sequence (AUadapt) from InfluenzaA__AGB13463__NA

SEQ ID NO: 25702 - RNA, 1410 nt, Artificial Sequence; identical to SEQ ID NO: 23111
  derived and/or modified CDS sequence (AUadapt) from InfluenzaA__AGB13473__NA

SEQ ID NO: 25703 - RNA, 1410 nt, Artificial Sequence
  derived and/or modified CDS sequence (AUadapt) from InfluenzaA__AGB13483__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggucgggcuacuccgggagcuucgugcagcacccggagcugacgggccuggacugcauccgccccugcuucuggguggagcucauccggggccagcccaaggagaacaccaucuggaccuccgggagcuccaucagcuucugcggcgucaacuccgacaccgugggguggagcuggcccgacggcgccgagcugccguucacgaucgacaaguga

SEQ ID NO: 25704 - RNA, 1410 nt, Artificial Sequence; identical to SEQ ID NO: 23396
  derived and/or modified CDS sequence (AUadapt) from InfluenzaA__AGB13493__NA

SEQ ID NO: 25705 - RNA, 1410 nt, Artificial Sequence; identical to SEQ ID NO: 23188
  derived and/or modified CDS sequence (AUadapt) from InfluenzaA__AGB13503__NA

SEQ ID NO: 25706 - RNA, 1410 nt, Artificial Sequence; identical to SEQ ID NO: 20602
  derived and/or modified CDS sequence (AUadapt) from InfluenzaA__AGB13513__NA

SEQ ID NO: 25707 - RNA, 1410 nt, Artificial Sequence; identical to SEQ ID NO: 23394
  derived and/or modified CDS sequence (AUadapt) from InfluenzaA__AGB13523__NA

SEQ ID NO: 25708 - RNA, 1410 nt, Artificial Sequence; identical to SEQ ID NO: 23394
  derived and/or modified CDS sequence (AUadapt) from InfluenzaA__AGB13533__NA

SEQ ID NO: 25709 - RNA, 1410 nt, Artificial Sequence; identical to SEQ ID NO: 23111
  derived and/or modified CDS sequence (AUadapt) from InfluenzaA__AGB13543__NA

SEQ ID NO: 25710 - RNA, 1410 nt, Artificial Sequence; identical to SEQ ID NO: 23111
  derived and/or modified CDS sequence (AUadapt) from InfluenzaA__AGB13553__NA

SEQ ID NO: 25711 - RNA, 1410 nt, Artificial Sequence
  derived and/or modified CDS sequence (AUadapt) from InfluenzaA__AGB13563__NA
augaaccccaaccagaagaucaucaccaucggcucggugugcaugaccaucggggucgccaaccugauccuccagaucggcaacaucaucuccaucuggaucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaaccuggccgggaacucgucccucugcccggugagcggcugggccaucuacuccaaggacaacagcauccgcaucggcuccaagggggacguguucgucauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgucggccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagaacaucagcagccggaagggcuucgagaugaucugggaccccaacggguggaccggcaccgacaacaacuucuccaucaagcaggacaucguggggaucaacgaguggagcggcuacuccgggucguucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 25712 - RNA, 1410 nt, Artificial Sequence; identical to SEQ ID NO: 23111
  derived and/or modified CDS sequence (AUadapt) from InfluenzaA__AGB13573__NA

SEQ ID NO: 25713 - RNA, 1410 nt, Artificial Sequence
  derived and/or modified CDS sequence (AUadapt) from InfluenzaA__AGB13583__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucggguccgugaagcuggccggcaacucgucccucugcccggugagcggcugggccaucuacuccaaggacaacagcauccgcaucggguccaagggcgacgucuucgugauccgggagcccuucaucagcugcucgccccuggagugccgcaccuucuuccugacccagggggcccuccugaacgacaagcacuccaacggcaccaucaaggaccggucccccuaccgcacgcugaugagcugcccgaucggggaggugcccucccccuacaacagccgguucgagagcgucgccugguccgcgucggccugccacgacggcaucaacuggcucaccaucggcaucuccgggcccgacaacggcgccguggccgugcugaaguacaacgggaucaucaccgacaccaucaagagcuggcgcaacaacauccugcggacgcaggaguccgagugcgcgugcgucaacggcagcugcuucaccaucaugaccgacggcccguccgacgggcaggccagcuacaagaucuuccgcaucgagaagggcaagaucgugaaguccguggagaugaacgcccccaacuaccacuacgaggagugcucgugcuaccccgacuccagcgagaucacgugcgucugccgggacaacuggcacggguccaaccgccccugggugagcuucaaccagaaccucgaguaccagaucggcuacaucugcuccgggaucuucggcgacaacccgcggcccaacgacaagaccggcagcugcgggcccguguccucgaacggcgccaacggggucaagggcuucuccuucaaguacgggaacggcguguggaucggccgcaccaagagcaucagcucccggaagggguucgagaugaucugggaccccaacggcuggaccgggaccgacaacaacuucagcaucaagcaggacaucgugggcaucaacgagugguccggguacucgggcuccuucguccagcacccggagcugacgggccuggacugcauccgccccugcuucuggguggagcucauccgggggcgccccaaggagaacaccaucuggaccagcggcuccagcaucuccuucugcggggugaacagcgacaccgucggcugguccuggcccgacggcgccgagcugccguucacgaucgacaaguga

SEQ ID NO: 25714 - RNA, 1410 nt, Artificial Sequence; identical to SEQ ID NO: 23111
  derived and/or modified CDS sequence (AUadapt) from InfluenzaA__AGB13593__NA

SEQ ID NO: 25715 - RNA, 1410 nt, Artificial Sequence; identical to SEQ ID NO: 23111
  derived and/or modified CDS sequence (AUadapt) from InfluenzaA__AGB13603__NA

SEQ ID NO: 25716 - RNA, 1410 nt, Artificial Sequence; identical to SEQ ID NO: 23111
  derived and/or modified CDS sequence (AUadapt) from InfluenzaA__AGB13613__NA

SEQ ID NO: 25717 - RNA, 1410 nt, Artificial Sequence; identical to SEQ ID NO: 23111
  derived and/or modified CDS sequence (AUadapt) from InfluenzaA__AGB13623__NA

SEQ ID NO: 25718 - RNA, 1410 nt, Artificial Sequence
  derived and/or modified CDS sequence (AUadapt) from InfluenzaA__AGB13633__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucgcgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagucgguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagucgaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcaucaucuccuucugcggcgucaacagcgacaccguggggugguccuggcccgacggcgccgagcugccguucacgaucgacaaguga

SEQ ID NO: 25719 - RNA, 1410 nt, Artificial Sequence
  derived and/or modified CDS sequence (AUadapt) from InfluenzaA__AGB13643__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacggcauccgcaucgggagcaagggcgacguguucgugauccgggagcccuucaucuccugcagcccccuggagugccgcaccuucuuccugacccagggggcccuccugaacgacaagcacuccaacggcaccaucaaggaccggagccccuaccgcacgcugauguccugcccgaucggggagguccccucgcccuacaacucccgguucgagagcguggccuggagcgcguccgccugccacgacggcaucaacuggcucaccaucggcaucagcgggcccgacaacggcgccguggccguccugaaguacaacgggaucaucaccgacaccaucaaguccuggcgcaacaacauccugcggacgcaggagagcgagugcgugugcgugaacggcuccugcuucaccgucaugaccgacggcccgucggacgggcaggcguccuacaagaucuuccgcaucgagaagggcaagaucgucaagagcguggagaugaacgcccccaacuaccacuacgaggagugcuccugcuaccccgacagcuccgagaucacgugcgugugccgggacaacuggcacgggagcaaccgccccuggguguccuucaaccagaaccucgaguaccagaucggcuacaucugcucggggaucuucggcgacaacccgcggcccaacgacaagaccggcuccugcgggcccgugagcuccaacggcgccaacggggucaagggcuucagcuucaaguacgggaacggcguguggaucggccgcaccaaguccaucagcagccggaacggguucgagaugaucugggaccccaacggcuggaccgggaccgacaacaacuucuccgugaagcaggacaucaucggcaucaacgaguggucgggguacuccggcagcuucguccagcacccggagcugacgggccuggacugcauccgccccugcuucuggguggagcucauccgggggcgccccaaggagaacaccaucuggaccuccggcagcuccaucagcuucugcggggucaacuccgacaccgugggcuggagcuggcccgacggcgccgagcugccguucacgaucgacaaguga

SEQ ID NO: 25720 - RNA, 1410 nt, Artificial Sequence
  derived and/or modified CDS sequence (AUadapt) from InfluenzaA__AGB13653__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgugugcgugaacgggagcugcuucaccgucaugaccgacggcccguccgacggccaggcgagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucucgucccggaacggcuucgagaugaucugggaccccaacggguggaccggcaccgacaacaacuucagcgugaagcaggacaucaucgggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 25721 - RNA, 1410 nt, Artificial Sequence; identical to SEQ ID NO: 22659
  derived and/or modified CDS sequence (AUadapt) from InfluenzaA__AGB13663__NA

SEQ ID NO: 25722 - RNA, 1410 nt, Artificial Sequence; identical to SEQ ID NO: 22659
  derived and/or modified CDS sequence (AUadapt) from InfluenzaA__AGB13724__NA

SEQ ID NO: 25723 - RNA, 1410 nt, Artificial Sequence; identical to SEQ ID NO: 23111
  derived and/or modified CDS sequence (AUadapt) from InfluenzaA__AGB13734__NA

SEQ ID NO: 25724 - RNA, 1410 nt, Artificial Sequence; identical to SEQ ID NO: 16317
  derived and/or modified CDS sequence (AUadapt) from InfluenzaA__AGB51359__NA

SEQ ID NO: 25725 - RNA, 1410 nt, Artificial Sequence
  derived and/or modified CDS sequence (AUadapt) from InfluenzaA__AGB97270__NA
augaaccccaaccagaagaucaucaccaucggcucggugugcaugaccaucgggauggccaaccugauccuccagaucggcaacaucaucuccaucuggaucagccacuccauccagcugcgcaaccagaaccagaucgagacgugcaaccagagcgucaucaccuacgagaacaacaccugggugaaccagaccuacgugaacaucuccaacacgaacuucgccgcggggcagagcgucguguccgugaagcuggccggcaacucgucccucugcccggucagcgggugggccaucuacuccaaggacaacagcauccggaucggcuccaagggcgacguguucgugauccgcgagcccuucaucagcugcagcccccuggagugccggaccuucuuccugacccagggggcccuccugaacgacaagcacuccaacggcaccaucaaggaccgcucccccuaccggacgcugaugucgugcccgaucggggagguccccucccccuacaacagccgcuucgagagcguggccugguccgcgagcgccugccacgacggcaucaacuggcucaccaucgggaucuccggccccgacaacggcgccauggccgugcugaaguacaacgggaucaucaccgacaccaucaagagcuggcggaacaacauccugcgcacgcaggaguccgagugcgcgugcgucaacggcucgugcuucaccaucaugaccgacgggccguccgacggccaggccagcuacaagaucuuccggaucgagaagggcaagaucgugaaguccguggagaugaacgcccccaacuaccacuacgaggagugcagcugcuaccccgacuccagcgagaucacgugcgucugccgcgacaacuggcacggguccaaccggcccugggugucguucaaccagaaccucgaguaccagaucggcuacaucugcuccgggaucuucggcgacaacccgcgccccaacgacaagaccgggagcugcggccccguguccagcaacggcgccaacggggucaagggcuucuccuucaaguacgggaacggcguguggaucgggcggaccaagagcaucagcucccgcaagggcuucgagaugaucugggaccccaacggcuggaccgggaccgacaacaacuucucgaucaagcaggacaucgugggcaucaacgagugguccggguacagcggcuccuucguccagcacccggagcugacggggcuggacugcauccggcccugcuucuggguggagcucauccgcggccggcccaaggagaacaccaucuggaccagcggcuccagcaucuccuucugcggggugaacagcgacaccgucggcugguccuggcccgacggggccgagcugccguucacgaucgacaaguga

SEQ ID NO: 25726 - RNA, 1410 nt, Artificial Sequence
  derived and/or modified CDS sequence (AUadapt) from InfluenzaA__AGB97274__NA
augaaccccaaccagaagaucaucaccaucggcucggugugcaugaccaucgggauggccaaccugauccuccagaucggcaacaucaucuccaucuggaucagccacuccauccagcugcgcaaccagaaccagaucgagacgugcaaccagagcgucaucaccuacgagaacaacaccugggugaaccagaccuacgugaacaucuccaacacgaacuucgccgcggggcagagcgucguguccgugaagcuggccggcaacucgucccucugcccggucagcgggugggccaucuacuccaaggacaacagcauccggaucggcuccaagggcgacguguucgugauccgcgagcccuucaucagcugcagcccccuggagugccggaccuucuuccugacccagggggcccuccugaacgacaagcacuccaacggcaccaucaaggaccgcucccccuaccggacgcugaugucgugcccgaucggggagguccccucccccuacaacagccgcuucgagagcguggccugguccgcgagcgccugccacgacggcaucaacuggcucaccaucgggaucuccggccccgacaacggcgccguggccguccugaaguacaacgggaucaucaccgacaccaucaagagcuggcggaacaacauccugcgcacgcaggaguccgagugcgcgugcgugaacggcucgugcuucaccaucaugaccgacgggccguccgacggccaggccagcuacaagaucuuccggaucgagaagggcaagaucgugaaguccgucgagaugaacgcccccaacuaccacuacgaggagugcagcugcuaccccgacuccagcgagaucacgugcgugugccgcgacaacuggcacggguccaaccggcccugggugucguucaaccagaaccucgaguaccagaucggcuacaucugcuccgggaucuucggcgacaacccgcgccccaacgacaagaccgggagcugcggccccgucuccagcaacggcgccaacggggugaagggcuucuccuucaaguacgggaacggcguguggaucgggcggaccaagagcaucagcucccgcaagggcuucgagaugaucugggaccccaacggcuggaccgggaccgacaacaacuucucgaucaagcaggacaucgucggcaucaacgagugguccggguacagcggcuccuucgugcagcacccggagcugacggggcuggacugcauccggcccugcuucuggguggagcucauccgcggccggcccaaggagaacaccaucuggaccagcggcuccagcaucuccuucugcggggucaacagcgacaccgugggcugguccuggcccgacggggccgagcugccguucacgaucgacaaguga

SEQ ID NO: 25727 - RNA, 1410 nt, Artificial Sequence; identical to SEQ ID NO: 16339
  derived and/or modified CDS sequence (AUadapt) from InfluenzaA__AGB97289__NA

SEQ ID NO: 25728 - RNA, 1410 nt, Artificial Sequence
  derived and/or modified CDS sequence (AUadapt) from InfluenzaA__AGE15475__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcucgaagggggacguguucgugauccgggagcccuucaucuccugcagcccccuggagugccgcaccuucuuccugacccagggcucccuccugaacgacaagcacagcaacgggaccaucaaggaccggucccccuaccgcacgcugaugagcugcccgaucggcgagguccccagccccuacaacucccgguucgagagcguggccugguccgccagcgcgugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgccugcgugaacgggucgugcuucaccaucaugaccgacggcccguccgacggccaggcgagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucucguucaaguacggcaacgggguguggaucggccgcaccaaguccaucagcucccggaagggcuucgagaugaucugggaccccaacggguggaccggcaccgacaacuacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucagcaucgacaaguga

SEQ ID NO: 25729 - RNA, 1410 nt, Artificial Sequence
  derived and/or modified CDS sequence (AUadapt) from InfluenzaA__AGE15476__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcucgaagggggacguguucgugauccgggagcccuucaucuccugcagcccccuggagugccgcaccuucuuccugacccagggcucccuccugaacgacaagcacagcaacgggaccaucaaggaccggucccccuaccgcacgcugaugagcugcccgaucggcgagguccccagccccuacaacucccgguucgagagcguggccugguccgccagcgcgugccacgacgggaucaacuggcucaccaucggcaucuccggccccgacaacggggccguggccguccugaaguacaacggcaucaucaccgacaccaucaagucguggcgcaacaacauccugcggacgcaggaguccgagugcgccugcgugaacgggagcugcuucaccaucaugaccgacggcccguccgacggccaggcgagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccucgaacggggccaacggcgugaagggguucagcuucaaguacggcaacgggguguggaucggccgcaccaaguccaucagcucccggaagggcuucgagaugaucugggaccccaacggguggaccggcaccgacaacuacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 25730 - RNA, 1410 nt, Artificial Sequence; identical to SEQ ID NO: 25560
  derived and/or modified CDS sequence (AUadapt) from InfluenzaA__AGE15477__NA

SEQ ID NO: 25731 - RNA, 1410 nt, Artificial Sequence
  derived and/or modified CDS sequence (AUadapt) from InfluenzaA__AGE15478__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcucgaagggggacguguucgugauccgggagcccuucaucuccugcagcccccuggagugccgcaccuucuuccugacccagggcucccuccugaacgacaagcacagcaacgggaccaucaaggaccggucccccuaccgcacgcugaugagcugcccgaucggcgagguccccagccccuacaacucccgguucgagagcguggccugguccgccagcgcgugccacgacgggaucaacuggcucaccaucggcaucuccggccccgacaacggggccguggccguccugaaguacaacggcaucaucaccgacaccaucaagucguggcgcaacaacauccugcggacgcaggaguccgagugcgccugcgugaacgggagcugcuucaccaucaugaccgacggcccguccgacggccaggcgagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccucgaacggggccaacggcgugaagggguucagcuucaaguacggcaacgggguguggaucggccgcaccaaguccaucagcucccggaagggcuucgagaugaucugggaccccaacggguggaccggcaccgacaacuacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaagagcgacaccguggggugguccuggcccgacggcgccgagcugccguucacgaucgacaaguga

SEQ ID NO: 25732 - RNA, 1410 nt, Artificial Sequence
  derived and/or modified CDS sequence (AUadapt) from InfluenzaA__AGE15479__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcucgaagggggacguguucgugauccgggagcccuucaucuccugcagcccccuggagugccgcaccuucuuccugacccagggcucccuccugaacgacaagcacagcaacgggaccaucaaggaccggucccccuaccgcacgcugaugagcugcccgaucggcgagguccccagccccuacaacucccgguucgagagcguggccugguccgccagcgcgugccacgacgggaucaacuggcucaccaucggcaucuccggccccgacaacggggccguggccguccugaaguacaacggcaucaucaccgacaccaucaagucguggcgcaacaacauccugcggacgcaggaguccgagugcgccugcgugaacgggagcugcuucaccaucaugaccgacggcccgaucgacggccaggcguccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucucguucaaguacggcaacgggguguggaucggccgcaccaagagcaucuccagccggaagggcuucgagaugaucugggaccccaacggguggaccggcaccgacaacuacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 25733 - RNA, 1410 nt, Artificial Sequence; identical to SEQ ID NO: 25560
  derived and/or modified CDS sequence (AUadapt) from InfluenzaA__AGE15480__NA

SEQ ID NO: 25734 - RNA, 1410 nt, Artificial Sequence; identical to SEQ ID NO: 20602
  derived and/or modified CDS sequence (AUadapt) from InfluenzaA__AGE89270__NA

SEQ ID NO: 25735 - RNA, 1410 nt, Artificial Sequence; identical to SEQ ID NO: 20602
  derived and/or modified CDS sequence (AUadapt) from InfluenzaA__AGE89280__NA

SEQ ID NO: 25736 - RNA, 1410 nt, Artificial Sequence
  derived and/or modified CDS sequence (AUadapt) from InfluenzaA__AGE89290__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaucguggucaugaccgacggguccgccucgggcaaggccgacaccaagauccucuucguggaggagggcaagaucgugcacaccagcacgcuguccgggagcgcgcagcacgucgaggagugcuccugcuacccccgcuaccccggcgugcggugcgugugccgcgacaacuggaaggggucgaaccggccgaucgucgacaucaacaucaaggaccacuccaucaucagcuccuacgugugcucgggccuggugggcgacacgccccgcaagaacgacuccagcuccucgucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagucgaagcugcagaucaaccgccaggugaucguggaccggggcaaccgguccggguacagcggcaucuucuccgucgagggcaagucgugcaucaaccgcugcuucuacguggagcucauccgggggcgcaaggaggagaccgaggugcuguggaccagcaacuccaucgucguguucugcggcaccagcgggacguacggcaccggguccuggccggacggcgccgaccugaaccucaugcccaucuga

SEQ ID NO: 25737 - RNA, 1410 nt, Artificial Sequence; identical to SEQ ID NO: 22659
  derived and/or modified CDS sequence (AUadapt) from InfluenzaA__AGE89301__NA

SEQ ID NO: 25738 - RNA, 1410 nt, Artificial Sequence
  derived and/or modified CDS sequence (AUadapt) from InfluenzaA__AGE89311__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggaagaacaacauccugcgcacgcaggaguccgagugcgcgugcgugaacgggagcugcuucaccgugaugaccgacggcccguccgacggccaggccagcuacaagaucuuccggaucgagaaggggaagaucgucaaguccguggagaugaacgcccccaacuaccacuacgaggagugcucgugcuaccccgacuccagcgagaucacgugcgugugccgcgacaacuggcacggcuccaaccggcccugggucagcuucaaccagaaccucgaguaccgcaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaagaagcaggacaucaucgggaucaacgagugguccggcuacucgggguccuucgugcagcacccggagcugacgggccuggacugcauccgccccugcuucuggguggagcucauccggggccgccccaaggagaacaccaucuggaccagcggguccagcauguccuucugcggcgucaacagcgacaccguggggugguccuggcccgacggcgccgagcugccguucacgaucgacaaguga

SEQ ID NO: 25739 - RNA, 1410 nt, Artificial Sequence; identical to SEQ ID NO: 24189
  derived and/or modified CDS sequence (AUadapt) from InfluenzaA__AGE89321__NA

SEQ ID NO: 25740 - RNA, 1410 nt, Artificial Sequence; identical to SEQ ID NO: 23545
  derived and/or modified CDS sequence (AUadapt) from InfluenzaA__AGE89332__NA

SEQ ID NO: 25741 - RNA, 1410 nt, Artificial Sequence; identical to SEQ ID NO: 22659
  derived and/or modified CDS sequence (AUadapt) from InfluenzaA__AGE89343__NA

SEQ ID NO: 25742 - RNA, 1410 nt, Artificial Sequence
  derived and/or modified CDS sequence (AUadapt) from InfluenzaA__AGE89353__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaucaccaucgagaaggagaucugccccaagcuggccgaguaccggaacuggucgaagccgcagugcgacaucacgggguucgcgcccuucuccaaggacaacagcauccgccuguccgccggcggggacaucugggucacccgggagcccuacgugucgugcgaccccgacaagugcuaccaguucgcccucggccaggggaccacccugaacaacgugcacuccaacaacacgguccgcgaccggaccccguaccgcacccugcucaugaacgagcugggcgugcccuuccaccugggcaccaagcaggucugcaucgccuggagcuccucguccugccacgacgggaaggccuggcuccacgugugcaucacgggcgacgacaagaacgcgaccgccagcuucaucuacaacgggcggcugguggacuccguggucucgugguccaaggagauccugcgcacccaggagagcgagugcgugugcaucaacgggaccugcacgguggucaugaccgacggguccgccucgggcaaggccgacaccaagauccucuucaucgaggagggcaagaucgugcacaccagcacgcuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccucgucccacugccucgaccccaacaacgaggagggcggccacggggucaagggcugggccuucgacgacgggaacgacguguggaugggccgcaccaucaacgagaccagccggcugggcuacgagaccuucaaggucaucgaggggugguccaaccccaagucgaagcugcagaucaaccgccaggugaucguggacaagggcaaccgguccggguacagcggcaucuucuccgucgagggcaagucgugcaucaaccgcugcuucuacguggagcucauccgggggcgcaaggaggagaccgaggugcuguggaccagcaacuccaucgucguguucugcggcaccagcgggacguacggcaccggguccuggccggacggcgccgaccugaaccucaugcccaucuga

SEQ ID NO: 25743 - RNA, 1410 nt, Artificial Sequence; identical to SEQ ID NO: 23396
  derived and/or modified CDS sequence (AUadapt) from InfluenzaA__AGE89364__NA

SEQ ID NO: 25744 - RNA, 1410 nt, Artificial Sequence; identical to SEQ ID NO: 24189
  derived and/or modified CDS sequence (AUadapt) from InfluenzaA__AGE89374__NA

SEQ ID NO: 25745 - RNA, 1410 nt, Artificial Sequence
  derived and/or modified CDS sequence (AUadapt) from InfluenzaA__AGE89385__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucgccuccgugaagcuggccgggaacucgucccucugcccggugagcggcugggccaucuacuccaaggacaacagcauccgcaucggcuccaagggggacgucuucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgcgugguccgccucggccugccacgacgggaucaacuggcucaccaucggcaucuccggccccgacaacggggccguggcggugcugaaguacaacggcaucaucaccgacaccaucaagagcuggcgcaacaacauccugcggacgcaggaguccgagugcgccugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccucgaacggggccaacggcgucaagggguucuccuucaaguacggcaacgggguguggaucggccgcaccaagagcaucagcucccggaagggcuucgagaugaucugggaccccaacggguggaccggcaccgacaacaacuucagcaucaagcaggacaucguggggaucaacgagugguccggcuacucgggguccuucguccagcacccggagcugacgggccuggacugcauccgccccugcuucuggguggagcucauccggggccgccccaaggagaacaccaucuggaccagcggguccagcaucuccuucugcggcgugaacagcgacaccgucgggugguccuggcccgacggcgcggagcugccguucacgaucgacaaguga

SEQ ID NO: 25746 - RNA, 1410 nt, Artificial Sequence
  derived and/or modified CDS sequence (AUadapt) from InfluenzaA__AGE89395__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcgggcacggggucaagggcugggccuucgacgacgggaacgacguguggaugggccgcaccaucaacgagacgucgcggcucggcuacgagaccuucaaggucaucgaggggugguccaaccccaagagcaagcugcagaucaaccgccaggugaucguggaccggggcaaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcccaucuga

SEQ ID NO: 25747 - RNA, 1410 nt, Artificial Sequence; identical to SEQ ID NO: 20602
  derived and/or modified CDS sequence (AUadapt) from InfluenzaA__AGE89425__NA

SEQ ID NO: 25748 - RNA, 1410 nt, Artificial Sequence; identical to SEQ ID NO: 21920
  derived and/or modified CDS sequence (AUadapt) from InfluenzaA__AGE89722__NA

SEQ ID NO: 25749 - RNA, 1410 nt, Artificial Sequence
  derived and/or modified CDS sequence (AUadapt) from InfluenzaA__AGE89733__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacagcaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccgaacgacggccaggccuccuacaagaucuuccgcaucgagaaggggaagaucgugaaguccgucgagaugaacgcccccaacuaccacuacgaggagugcuccugcuaccccgacucguccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucucguucaaguacggcaacgggguguggaucggccgcaccaaguccaucagcagccggaagggcuucgagaugaucugggaccccaacggguggaccggcaccgacaacaacuucuccaucaagcaggacaucgucgggaucaacgaguggagcggcuacuccgggucguucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 25750 - RNA, 1410 nt, Artificial Sequence
  derived and/or modified CDS sequence (AUadapt) from InfluenzaA__AGE89743__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggacaaggacaaccgguccggcuacucggggaucuucuccgucgagggcaagagcugcaucaaccgcugcuucuacguggagcucauccgggggcgcaaggaggagaccgaggugcuguggaccucgaacuccaucgucguguucugcggcacgagcggcaccuacgggaccggcuccuggccggacggggccgaccugaaccucaugcccaucuga

SEQ ID NO: 25751 - RNA, 1410 nt, Artificial Sequence; identical to SEQ ID NO: 24189
  derived and/or modified CDS sequence (AUadapt) from InfluenzaA__AGE89754__NA

SEQ ID NO: 25752 - RNA, 1410 nt, Artificial Sequence; identical to SEQ ID NO: 24189
  derived and/or modified CDS sequence (AUadapt) from InfluenzaA__AGE89765__NA

SEQ ID NO: 25753 - RNA, 1410 nt, Artificial Sequence
  derived and/or modified CDS sequence (AUadapt) from InfluenzaA__AGG13414__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacuccgugcacucgaacaacaccguccgcgaccggacccccuaccgcacccugcugaugaacgagcucggcgugcccuuccaccugggcacgaagcaggucugcaucgccugguccagcuccucgugccacgacgggaaggccuggcugcacgugugcaucaccggcgacgacaagaacgcgaccgccuccuucaucuacaacgggcggcucguggacagcguggucuccuggucgaaggagauccugcgcacccaggaguccgagugcgugugcaucaacggcacgugcaccguggucaugaccgacgggagcgccucgggcaaggccgacaccaagauccuguucaucgaggagggcaagaucgugcacacguccacccucucgggguccgcgcagcacguggaggagugcagcugcuacccccgguacccgggcguccgcugcgugugccgggacaacuggaagggguccaaccgccccaucguggacaucaacaucaaggaccacucgaucgucucccgguacgugugcagcggccuggugggcgacaccccgcgcaagaacgacuccucguccagcucccacugccuggaccccaacaacgaggagggcgggcacggggucaagggcugggccuucgacgacgggaacgacguguggaugggccggaccaucaacgagacgucgcgccucggcuacgagaccuucaaggucaucgaggggugguccaaccccaagagcaagcugcagaucaacaagcaggucaucguggaccggggcgaccgcuccggguacucgggcaucuucuccguggagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcccaucuga

SEQ ID NO: 25754 - RNA, 1410 nt, Artificial Sequence; identical to SEQ ID NO: 16339
  derived and/or modified CDS sequence (AUadapt) from InfluenzaA__AGG13426__NA

SEQ ID NO: 25755 - RNA, 1410 nt, Artificial Sequence; identical to SEQ ID NO: 16339
  derived and/or modified CDS sequence (AUadapt) from InfluenzaA__AGG13438__NA

SEQ ID NO: 25756 - RNA, 1410 nt, Artificial Sequence
  derived and/or modified CDS sequence (AUadapt) from InfluenzaA__AGG13498__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucucgugguccaaggacauccugcgcacccaggagagcgagugcgugugcaucaacggcacgugcgccguggucaugaccgacggguccgccucgggcaaggcggacaccaagauccucuucaucgaggagggcaagaucgugcacaccagcacgcuguccgggucggcccagcacguggaggagugcuccugcuacccccgguaccccggcguccgcugcgugugccgggacaacuggaaggggagcaaccgcccgaucguggacaucaacaucaaggaccacuccaucgucucguccuacgugugcucgggccuggugggcgacacgccccggaagaacgacuccagcuccucggggcacugccucgaccccaacaacgaggagggcgggcacggcgucaaggggugggccuucgacgacggcaacgacguguggaugggccgcaccaucaacgagaccucccggcugggguacgagaccuucaaggucaucgagggcuggagcaaccccaaguccaagcugcagaucaaccgccaggugaucguggaccgggggaaccgcucgggcuacuccgggaucuucagcgucgagggcaagaacugcaucaaccggugcuucuacguggagcucauccgcggccggaaggaggagaccgaggugcuguggaccuccaacucgaucgucguguucugcgggaccagcggcacguacgggaccggcuccuggccggacggggccgaccugaaccucaugcccaucuga

SEQ ID NO: 25757 - RNA, 1410 nt, Artificial Sequence; identical to SEQ ID NO: 16339
  derived and/or modified CDS sequence (AUadapt) from InfluenzaA__AGG13510__NA

SEQ ID NO: 25758 - RNA, 1410 nt, Artificial Sequence; identical to SEQ ID NO: 25756
  derived and/or modified CDS sequence (AUadapt) from InfluenzaA__AGG13522__NA

SEQ ID NO: 25759 - RNA, 1410 nt, Artificial Sequence
  derived and/or modified CDS sequence (AUadapt) from InfluenzaA__AGG13534__NA
augaaccccaaccagaagaucaucaccaucggcucggugucccugaccaucucgacggucugcuucuucaugcagaucgccauccucaucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccgucgugagcugguccaaggagauccugcgcacccaggagucggagugcgugugcaucaacgggacgugcaccgucgugaugaccgacggcuccgccagcggcaaggccgacaccaagauccuguucaucgaggaggggaagaucgugcacacgucgacccucuccggcucggcgcagcacgucgaggagugcuccugcuacccccgguacccgggggugcgcugcgugugccgggacaacuggaagggcagcaaccgccccaucgucgacaucaacaucaaggaccacuccaucgugucguccuacgugugcagcggccuggucggggacaccccgcggaagaacgacuccucguccagcucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggugaucgucgaccgcggggaccgguccggcuacucggggaucuucuccguggagggcaagagcugcaucaaccggugcuucuacguggagcugauccgcggccggaaggaggagaccgagguccucuggaccucgaacuccaucgugguguucugcgggacgagcggcaccuacgggaccggcuccuggcccgacggggccgaccugaaccugaugcccaucuga

SEQ ID NO: 25760 - RNA, 1410 nt, Artificial Sequence
  derived and/or modified CDS sequence (AUadapt) from InfluenzaA__AGG13546__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcagcgcgcagcacguggaggagugcuccugcuacccccgguacccggggguccgcugcgugugccgggacaacuggcgcggcucgaaccggcccaucguggacaucaacaucaaggaccacuccaucgucagcuccuacgugugcucgggccuggugggggacaccccgcgcaagaacgacuccagcuccucgucccacugccuggaccccaacaacgaggagggcgggcacggcgucaaggggugggccuucgacgacggcaacgacguguggaugggccggaccaucaacgagacgagccgccucggguacgagaccuucaaggucaucgagggcugguccaaccccaagucgaagcugcagaucaaccgccaggugaucguggaccgguccgaccggagcggguacuccggcaucuucucggucgagggcaagagcugcaucaaccgcugcuucuacguggagcugauccgggggcgcaaggaggagaccgaggugcucuggaccuccaacucgaucgucguguucugcggcacguccgggaccuacggcaccgggagcuggcccgacggcgccgaccugaaccugaugcccaucuga

SEQ ID NO: 25761 - RNA, 1410 nt, Artificial Sequence; identical to SEQ ID NO: 16339
  derived and/or modified CDS sequence (AUadapt) from InfluenzaA__AGG13558__NA

SEQ ID NO: 25762 - RNA, 1410 nt, Artificial Sequence; identical to SEQ ID NO: 16339
  derived and/or modified CDS sequence (AUadapt) from InfluenzaA__AGG13570__NA

SEQ ID NO: 25763 - RNA, 1410 nt, Artificial Sequence
  derived and/or modified CDS sequence (AUadapt) from InfluenzaA__AGG13582__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggaggacaagaacgcgaccgccagcuucaucuacaacggccggcucguggacuccguggucucgugguccaaggagacccugcgcacgcaggagagcgagugcgugugcaucaacgggaccugcaccguggucaugaccgacggcuccgccucgggcaaggccgacacgaagauccuguucaucgaggaggggaagaucgugcacaccagcacccucuccggcucggcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacaccccgcggaagaacgacuccagcuccucgucccacugccuggaccccaacaacgaggagggcgggcacggcgucaaggggugggccuucgacgacggcaacgacguguggaugggccgcacgaucaacgagaccucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggacgucgaacuccaucgucguguucugcgggaccagcggcaccuacgggaccggcuccuggcccgacggggccgaccugaaccugaugcccaucuga

SEQ ID NO: 25764 - RNA, 1410 nt, Artificial Sequence; identical to SEQ ID NO: 16339
  derived and/or modified CDS sequence (AUadapt) from InfluenzaA__AGG13606__NA

SEQ ID NO: 25765 - RNA, 1410 nt, Artificial Sequence
  derived and/or modified CDS sequence (AUadapt) from InfluenzaA__AGG13618__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggagauccugcgcacccaggagagcgagugcgugugcaucaacgggacgugcaccguggucaugaccgacggcuccgccucgggcaaggccgacaccaagauccuguucaucgaggaggggaagaucgugcacacgagcacccucuccggcucggcgcagcacguggaggagugcuccugcuacccccgguacccggggguccgcugcgugugccgggacaacuggaagggcucgaaccgccccaucguggacaucaacaucaaggaccacuccaucgucagcuccuaccugugcucgggccuggugggggacacgccccggaagaacgacggcuccagcuccucgcacugccucgaccccaacaacgaggagggcgggcacggggugaagggcugggccuucgacgacggcaacgacgucuggauggggcgcaccaucaacgagaccucccggcugggcuacgagaccuucaaggugaucgagggguggucgaacccgaaguccaagcugcagaucaaccgccagaucaucgucgaccggggcgaccgcagcggguacuccggcaucuucucgguggagggcaaguccugcaucaaccggugcuucuacguggagcucauccgcgggcggaaggaggagaccgagguccuguggaccagcaacucgaucgugguguucugcggcacguccgggaccuacggcaccgggagcuggcccgacggcgccgaccugaaccucaugcccaucuga

SEQ ID NO: 25766 - RNA, 1410 nt, Artificial Sequence
  derived and/or modified CDS sequence (AUadapt) from InfluenzaA__AGG13630__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggaggacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 25767 - RNA, 1410 nt, Artificial Sequence; identical to SEQ ID NO: 16339
  derived and/or modified CDS sequence (AUadapt) from InfluenzaA__AGG13642__NA

SEQ ID NO: 25768 - RNA, 1410 nt, Artificial Sequence
  derived and/or modified CDS sequence (AUadapt) from InfluenzaA__AGG13654__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggacauccugcgcacccaggagucggagugcgugugcaucaacggcacgugcgccguggucaugaccgacggguccgccagcggcaaggcggacaccaagauccucuucaucgaggagggcaagaucgugcagaccucgacgcuguccgggagcgcccagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccucggggcacugccucgaccccaacaacgaggagggcgggcacggcgucaaggggugggccuucgacgacggcaacgacguguggaugggccgcaccaucaacgagaccucccggcugggguacgagaccuucaaggucaucgagggcuggagcaaccccaaguccaagcugcagaucaaccgccaggugaucguggaccgggggaaccgcucgggcuacuccgggaucuucagcgucgagggcaagaacugcaucaaccggugcuucuacguggagcucauccgcggccggaaggaggagaucgaggugcuguggaccuccaacucgaucgucguguucugcgggaccagcggcaccuacgggacgggcuccuggccggacggggccgaccugaaccucaugcccaucuga

SEQ ID NO: 25769 - RNA, 1410 nt, Artificial Sequence; identical to SEQ ID NO: 25759
  derived and/or modified CDS sequence (AUadapt) from InfluenzaA__AGG13666__NA

SEQ ID NO: 25770 - RNA, 1410 nt, Artificial Sequence
  derived and/or modified CDS sequence (AUadapt) from InfluenzaA__AGG13678__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgccccuguccaaggacaacucgauccgccuguccgccgggggcgacaucugggucacccgggagcccuacgugucgugcgacccggacaagugcuaccaguucgcccucgggcagggcaccacgcugaacaacgugcacuccaacaacaccguccgcgaccggacccccuaccgcacccugcucaugaacgagcugggcgugcccuuccaccuggggacgaagcaggucugcaucgccuggagcuccucguccugccacgacggcaaggccuggcuccacgugugcaucaccggggacgacaagaacgcgaccgccagcuucaucuacaacggccggcugguggacuccguggucucgugguccaaggagauccugcgcacccaggagucggagugcgugugcaucaacgggacgugcaccguggucaugaccgacggcuccgccagcggcaaggccgacaccaagauccucuucaucgaggaggggaagaucgugcacacgucgacccuguccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccucgucccacugccucggccccaacaacgaggagggcgggcacggggucaagggcugggccuucgacgacggcaacgacguguggauggggcgcaccaucaacgagacgagccggcugggcuacgagaccuucaaggucaucgaggggugguccaaccccaagucgaagcugcagaucaaccgccaggugaucguggaccggggcgaccgcuccggguacucgggcaucuucuccgucgagggcaagagcugcaucaaccggugcuucuacguggagcucauccgcgggcggaaggaggagaccgaggugcuguggaccucgaacuccaucgucguguucugcggcacggccgggaccuacggcaccgggagcuggcccgacggcgccgaccugaaccucaugcccaucuga

SEQ ID NO: 25771 - RNA, 1410 nt, Artificial Sequence; identical to SEQ ID NO: 16339
  derived and/or modified CDS sequence (AUadapt) from InfluenzaA__AGG13690__NA

SEQ ID NO: 25772 - RNA, 1410 nt, Artificial Sequence
  derived and/or modified CDS sequence (AUadapt) from InfluenzaA__AGG13702__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugucgugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccucguccugccacgacgggaaggccuggcugcacgugugcaucaccggcgacgacaagaacgcgaccgccagcuucaucuacaacgggcggcucguggacuccguggucucgugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggaacgcgcagcacguggaggagugcagcugcuacccccgguacccgggcguccgcugcgugugccgggacaacuggaagggguccaaccgccccaucguggacaucaacaucaaggaccacucgaucgucucccgguacgugugcucgggccuggugggcgacaccccgcgcaagaacgacuccagcuccucgucccacugccuggaccccaacaacgaggagggcgggcacggggucaagggcugggccuucgacgacgggaacgacguguggaugggccggaccaucaacgagacgagccgccucggcuacgagaccuucaaggucaucgaggggugguccaaccccaagucgaagcugcagaucaaccgccaggugaucguggaccggggcgaccgguccggguacucgggcaucuucuccgucgagggcaagagcugcaucaaccgcugcuucuacguggagcugauccgggggcgcaaggaggagaccgaggugcucuggaccuccaacucgaucgucguguucugcggcacgagcgggaccuacggcaccggguccuggcccgacggcgccgaccugaaccugaugcccaucuga

SEQ ID NO: 25773 - RNA, 1410 nt, Artificial Sequence; identical to SEQ ID NO: 25756
  derived and/or modified CDS sequence (AUadapt) from InfluenzaA__AGG13714__NA

SEQ ID NO: 25774 - RNA, 1410 nt, Artificial Sequence; identical to SEQ ID NO: 16339
  derived and/or modified CDS sequence (AUadapt) from InfluenzaA__AGG13726__NA

SEQ ID NO: 25775 - RNA, 1410 nt, Artificial Sequence; identical to SEQ ID NO: 16339
  derived and/or modified CDS sequence (AUadapt) from InfluenzaA__AGG13738__NA

SEQ ID NO: 25776 - RNA, 1410 nt, Artificial Sequence; identical to SEQ ID NO: 16339
  derived and/or modified CDS sequence (AUadapt) from InfluenzaA__AGG13750__NA

SEQ ID NO: 25777 - RNA, 1410 nt, Artificial Sequence
  derived and/or modified CDS sequence (AUadapt) from InfluenzaA__AGG13762__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccucguccugccacgacgggaaggccuggcugcacgugugcaucaccggcgacgacaagaacgcgaccgccagcuucaucuacaacgggcggcucguggacuccguggucucgugguccaaggagauccugcgcacccaggagagcgagugcgugugcaucaacggcacgugcaccguggucaugaccgacggguccgccucgggcaaggccgacaccaagauccuguucaucgaggagggcaagaucgugcacacgagcacccucuccgggucggcgcagcacguggaggagugcuccugcuacccccgguacccgggcguccgcugcgugugccgggacaacuggaaggggucgaaccgccccaucguggacaucaacaucaaggaccacuccaucgucagccgguacgugugcuccggccuggugggcgacacgccccgcaagaacgacucguccagcuccucgcacugccuggaccccaacaacgaggagggcgggcacggggucaagggcugggccuucgacgacgggaacgacguguggaugggccggaccaucaacgagaccucccgccucggcuacgagaccuucaaggucaucgagggguggucgaacccgaaguccaagcugcagaucaaccgccaggugaucguggaccggggcgaccggagcggguacuccggcaucuucucggucgaggggaaguccugcaucaaccgcugcuucuacguggagcugauccggggccgcaaggaggagaccgaggugcucuggaccagcaacucgaucgucguguucugcggcacguccgggaccuacggcaccgggagcuggcccgacggcgccgaccugaaccugaugcccaucuga

SEQ ID NO: 25778 - RNA, 1410 nt, Artificial Sequence
  derived and/or modified CDS sequence (AUadapt) from InfluenzaA__AGG13774__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaccaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugucgugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggacauccugcgcacgcaggagucggagugcgugugcaucaacgggaccugcgccguggucaugaccgacggcuccgccagcggcaaggcggacaccaagauccucuucaucgaggagggcaagaucgugcacacgucgacccuguccgggagcgcccagcacguggaggagugcuccugcuacccccgguaccccggcguccgcugcgugugccgggacaacuggaaggggucgaaccgcccgaucguggacaucaacaucaaggaccacuccaucgucucguccuacgugugcagcggccuggugggcgacacgccccggaagaacgacuccucguccagcgggcacugccucgaccccaacaacgaggagggcgggcacggcgucaaggggugggccuucgacgacggcaacgacguguggaugggccgcaccaucaacgagaccucccggcugggguacgagaccuucaaggucaucgagggcuggucgaaccccaaguccaagcugcagaucaaccgccaggugaucguggaccgggggaaccgcucgggcuacuccgggaucuucagcgucgagggcaagaacugcaucaaccggugcuucuacguggagcucauccgcggccggaaggaggagaccgaggugcuguggaccuccaacucgaucgucguguucugcgggacgagcggcaccuacgggaccggcuccuggccggacggggccgaccugaaccucaugcccaucuga

SEQ ID NO: 25779 - RNA, 1410 nt, Artificial Sequence
  derived and/or modified CDS sequence (AUadapt) from InfluenzaA__AGG13786__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaaccugcacuccaacaacaccgugcgcgaccggacccccuaccgcacccugcucaugaacgagcugggcguccccuuccaccuggggacgaagcaggucugcaucgccuggucguccagcuccugccacgacggcaaggccuggcuccacgugugcaucaccggggacgacaagaacgcgaccgccucguucaucuacaacggccggcugguggacuccguggugagcugguccaaggagauccugcgcacccaggagucggagugcgucugcaucaacgggacgugcaccguggugaugaccgacggcuccgccagcggcaaggccgacaccaagauccucuucaucgaggaggggaagaucguccacacgucgacccuguccggcucggcgcagcacguggaggagugcuccugcuacccccgguacccgggggugcgcugcgucugccgggacaacuggaagggcagcaaccgccccaucguggacaucaacaucaaggaccacuccaucgugucguccuacgucugcagcggccuggugggggacaccccgcggaagaacgacuccucguccagcucccacugccucgaccccaacaacgaggagggcgggcacggcgugaaggggugggccuucgacgacggcaacgacgucuggaugggccgcaccaucaacgagacgucgcggcugggguacgagaccuucaaggugaucgagggcugguccaaccccaagagcaagcugcagaucaaccgccaggucaucguggaccgcggggaccgguccggcuacucggggaucuucuccguggagggcaagagcugcaucaaccggugcuucuacgucgagcucauccgcggccggaaggaggagaccgaggugcuguggaccucgaacuccaucguggucuucugcgggacgagcggcaccuacgggaccggcuccuggcccgacggggccgaccugaaccucaugcccaucuga

SEQ ID NO: 25780 - RNA, 1410 nt, Artificial Sequence; identical to SEQ ID NO: 25756
  derived and/or modified CDS sequence (AUadapt) from InfluenzaA__AGG13798__NA

SEQ ID NO: 25781 - RNA, 1410 nt, Artificial Sequence
  derived and/or modified CDS sequence (AUadapt) from InfluenzaA__AGG13810__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccucguccugccacgacgggaaggccuggcugcacgugugcaucaccggcgacgacaagaacgcgaccgccagcuucaucuacaacgggcggcucguggacuccguggucucgugguccaaggagauccugcgcacccaggagagcgagugcgugugcaucaacggcacgugcaccguggucaugaccgacggguccgccucgggcaaggccgacaccaagauccuguucaucgaggagggcaagaucgugcacacgagcacccucuccgggucggcgcagcacguggaggagugcuccugcuacccccgguacccgggcguccgcugcgugugccgggacaacuggaaggggucgaaccgccccaucguggacaucaacaucaaggaccacuccaucgucagccgguacgugugcuccggccuggugggcgacacgccccgcaagaacgacucguccagcuccucgcacugccuggggcccaacaacgaggagggcgggcacggcgucaaggggugggccuucgacgacggcaacgacguguggaugggccggaccaucaacgagaccucccgccucggguacgagaccuucaaggucaucgagggcuggucgaacccgaaguccaagcugcagaucaaccggcaggucaucguggaccgcggggaccggagcggcuacuccgggaucuucucgguggagggcaaguccugcaucaaccgcugcuucuacguggagcugauccggggccgcaaggaggagaccgaggugcucuggaccagcaacucgaucgucguguucugcgggacguccggcaccuacgggaccggcagcuggcccgacggggccgaccugaaccugaugcccaucuga

SEQ ID NO: 25782 - RNA, 1410 nt, Artificial Sequence; identical to SEQ ID NO: 25756
  derived and/or modified CDS sequence (AUadapt) from InfluenzaA__AGG13822__NA

SEQ ID NO: 25783 - RNA, 1410 nt, Artificial Sequence; identical to SEQ ID NO: 25756
  derived and/or modified CDS sequence (AUadapt) from InfluenzaA__AGG13834__NA

SEQ ID NO: 25784 - RNA, 1410 nt, Artificial Sequence; identical to SEQ ID NO: 25777
  derived and/or modified CDS sequence (AUadapt) from InfluenzaA__AGG13846__NA

SEQ ID NO: 25785 - RNA, 1410 nt, Artificial Sequence; identical to SEQ ID NO: 16339
  derived and/or modified CDS sequence (AUadapt) from InfluenzaA__AGG13858__NA

SEQ ID NO: 25786 - RNA, 1410 nt, Artificial Sequence
  derived and/or modified CDS sequence (AUadapt) from InfluenzaA__AGG13870__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggaccgcugcuaccaguucgcccuggggcagggcaccacgcucaacaacaugcacuccaacaacaccgugcgggaccgcacccccuaccggacccugcugaugaacgagcucggcguccccuuccaccuggggacgaagcaggucugcaucgccuggucguccagcuccugccacgacggcaaggccuggcugcacgugugcaucaccggggacgacaagaacgcgaccgccucguucaucuacaacggccgccucguggacuccguggugagcugguccaaggagauccugcggacccaggagucggagugcgucugcaucaacgggacgugcaccguggugaugaccgacggcuccgccagcggcaaggccgacaccaagauccuguucaucgaggaggggaagaucguccacacgucgacccucuccggcucggcgcagcacguggaggagugcuccugcuacccccgcuacccgggggugcggugcgucugccgcgacaacuggaagggcagcaaccggcccaucguggacaucaacaucaaggaccacuccaucgugucguccuacgucugcagcggccuggugggggacaccccgcgcaagaacgacuccucguccagcucccacugccuggaccccaacaacgaggagggcgggcacggcgugaaggggugggccuucgacgacggcaacgacgucuggaugggccggaccaucaacgagacgucgcgccucggguacgagaccuucaaggugaucgagggcugguccaaccccaagagcaagcugcagaucaaccggcaggucaucguggaccgcggggaccgguccggcuacucggggaucuucuccguggagggcaccagcugcaucaaccgcugcuucuacgucgagcugauccggggccgcaaggaggagaccgaggugcucuggacgucgaacuccaucguggucuucugcgggaccagcggcaccuacgggaccggcuccuggcccgacggggccgaccugaaccugaugcccaucuga

SEQ ID NO: 25787 - RNA, 1410 nt, Artificial Sequence
  derived and/or modified CDS sequence (AUadapt) from InfluenzaA__AGG13894__NA
augaaccccaaccagaagaucaucaccaucggcucggugucccugaccaucucgacggucugcuucuucaugcagaucgccauccucaucaccaccgugacccugcacuucaagcaguacgaguucaacuccccgcccaacaaccaggugaugcugugcgagcccacgaucaucgagcgcaacgucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggugacccgggagcccuacgucagcugcgacccggacaagugcuaccaguucgcccuggggcagggcaccacgcucaacaacgugcacuccaacaacaccgugcgcgaccggacccccuaccgcacccugcugaugaacgagcucggcguccccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggugagcugguccaaggagauccugcgcacccaggagucggagugcgucugcaucaacgggacgugcaccguggugaugaccgacggcuccgccagcggcaaggccgacaccaagauccuguucaucgaggaggggaagaucguccacacgucgacccucuccggcucggcgcagcacguggaggagugcuccugcuacccccgguacccgggggugcgcugcgucugccgggacaacuggaagggcagcaaccgccccaucguggacaucaacaucaaggaccacuccaucgugucguccuacgucugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggugaucgagggcugguccaaccccaagagcaagcugcagaucaaccgccaggucaucguggaccgcggggaccgguccggcuacucggggaucuucuccguggagggcaagagcugcaucaaccggugcuucuacgucgagcugauccgcggccggaaggaggagaccgaggugcucuggaccucgaacuccaucguggucuucugcgggacgagcggcaccuacgggaccggcuccuggcccgacggggccgaccugaaccugaugcccaucuga

SEQ ID NO: 25788 - RNA, 1410 nt, Artificial Sequence; identical to SEQ ID NO: 25756
  derived and/or modified CDS sequence (AUadapt) from InfluenzaA__AGG13906__NA

SEQ ID NO: 25789 - RNA, 1410 nt, Artificial Sequence
  derived and/or modified CDS sequence (AUadapt) from InfluenzaA__AGG13930__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggagauccugcgcacccaggagagcgagugcgugugcaucaacgggacgugcaccguggucaugaccgacggcuccgccucgggcaaggccgacaccaagauccuguucaucgaggaggggaagaucgugcacacgagcacccucuccggcucggcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacacgccccggaagaacgaccgcuccagcuccucgcacugccuggaccccaacaacgaggagggcgggcacggcgucaaggggugggccuucgacgacggcaacgacguguggaugggccggaccaucaacgagaccucccgccucggguacgagaccuucaaggucaucgagggcuggucgaacccgaaguccaagcugcagaucaaccggcaggucaucguggaccgcggggaccggagcggcuacuccgggaucuucucgguggagggcaaguccugcaucaaccgcugcuucuacguggagcugauccggggccgcaaggaggagaccgaggugcucuggaccagcaacucgaucgucguguucugcgggacguccggcaccuacgggaccggcagcuggcccgacggggccgaccugaaccugaugcccaucuga

SEQ ID NO: 25790 - RNA, 1410 nt, Artificial Sequence; identical to SEQ ID NO: 25766
  derived and/or modified CDS sequence (AUadapt) from InfluenzaA__AGG13942__NA

SEQ ID NO: 25791 - RNA, 1410 nt, Artificial Sequence
  derived and/or modified CDS sequence (AUadapt) from InfluenzaA__AGG13965__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacucgcgguucgaguccguggccuggagcgcguccgccugccacgacgggaucaacuggcucaccaucggcaucagcggccccgacuccggggccgucgccgugcugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucagcuucaaguacggcaacggggucuggaucggccgcaccaaguccaucucgucccggaagggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 25792 - RNA, 1410 nt, Artificial Sequence; identical to SEQ ID NO: 25759
  derived and/or modified CDS sequence (AUadapt) from InfluenzaA__AGG13976__NA

SEQ ID NO: 25793 - RNA, 1410 nt, Artificial Sequence; identical to SEQ ID NO: 25759
  derived and/or modified CDS sequence (AUadapt) from InfluenzaA__AGG13988__NA

SEQ ID NO: 25794 - RNA, 1410 nt, Artificial Sequence; identical to SEQ ID NO: 25759
  derived and/or modified CDS sequence (AUadapt) from InfluenzaA__AGG14000__NA

SEQ ID NO: 25795 - RNA, 1410 nt, Artificial Sequence; identical to SEQ ID NO: 25759
  derived and/or modified CDS sequence (AUadapt) from InfluenzaA__AGG14012__NA

SEQ ID NO: 25796 - RNA, 1410 nt, Artificial Sequence; identical to SEQ ID NO: 25777
  derived and/or modified CDS sequence (AUadapt) from InfluenzaA__AGG14024__NA

SEQ ID NO: 25797 - RNA, 1410 nt, Artificial Sequence
  derived and/or modified CDS sequence (AUadapt) from InfluenzaA__AGG14036__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucucgugguccaaggacauccugcgcacccaggagagcgagugcgugugcaucaacggcacgugcgccguggucaugaccgacggguccgccucgggcaaggcggacaccaagauccucuucaucgaggagggcaagaucgugcacaccagcacgcuguccgggucggcccagcacguggaggagugcuccugcuacccccgguaccccggcguccgcugcgugugccgggacaacuggaaggggagcaaccgcccgaucguggacaucaacaucaaggaccacuccaucgucucguccuacaugugcucgggccuggugggcgacacgccccggaagaacgacuccagcuccucggggcacugccucgaccccaacaacgaggagggcgggcacggcgugaaggggugggccuucgacgacggcaacgacgucuggaugggccgcaccaucaacgagaccucccggcugggguacgagaccuucaaggugaucgagggcuggagcaaccccaaguccaagcugcagaucaaccgccaggucaucguggaccgggggaaccgcucgggcuacuccgggaucuucagcguggagggcaagaacugcaucaaccggugcuucuacgucgagcucauccgcggccggaaggaggagaccgaggugcuguggaccuccaacucgaucguggucuucugcgggaccagcggcacguacgggaccggcuccuggccggacggggccgaccugaaccucaugcccaucuga

SEQ ID NO: 25798 - RNA, 1410 nt, Artificial Sequence; identical to SEQ ID NO: 25777
  derived and/or modified CDS sequence (AUadapt) from InfluenzaA__AGG14321__NA

SEQ ID NO: 25799 - RNA, 1410 nt, Artificial Sequence; identical to SEQ ID NO: 16339
  derived and/or modified CDS sequence (AUadapt) from InfluenzaA__AGG14333__NA

SEQ ID NO: 25800 - RNA, 1410 nt, Artificial Sequence; identical to SEQ ID NO: 24189
  derived and/or modified CDS sequence (AUadapt) from InfluenzaA__AGG84182__NA

SEQ ID NO: 25801 - RNA, 1398 nt, Artificial Sequence
  derived and/or modified CDS sequence (AUadapt) from InfluenzaA__AGJ51955__NA
augaaucccaaccagaagauccugugcaccucggccaccgccaucaucaucggcgcgaucgccgugcucaucgggaucgccaaccugggccugaacaucgggcuccaccugaagccgggcugcaacugcucccacucgcagcccgagacgaccaacaccucccagaccaucaucaacaauuacuacaacgagacgaacaucaccaacauccagauggaggagcgcaccucgcggaacuucaacaaccugaccaaggggcucugcacgaucaacuccuggcacaucuauggcaaggacaacgccguccgcaucggcgagucguccgacgugcuggugacccgggagcccuacgucucgugcgaccccgacgagugccgcuucuacgcccugucccaggggaccaccauccggggcaagcacaguaacgggacgauccacgaccgcucccaguaccgggcgcucaucucguggccgcuguccucgccgcccaccguguacaacucccgcguggagugcaucggcuggucguccaccucgugccacgaugggaagucccggaugucgaucugcaucucgggccccaacaacaacgccuccgccgucgugugguacaaccgccggcccguggccgagaucaacaccugggcgcgcaacauccugcggacgcaggagucggagugcgucugccacaauggcgugugccccguggucuucaccgacggguccgccaccggccccgccgacacccgcaucuacuacuucaaggaggggaagauccucaagugggagucgcugacgggcaccgccaagcacaucgaggagugcuccugcuacggcgagcggaccgggaucacgugcacgugucgcgacaacuggcagggcucgaaccggcccgugauccagaucgacccgguggccaugacccacaccucccaguacaucugcucgcccguccugaccgacaacccccgccccaacgacccgaauaucgggaagugcaacgaccccuaccccggcaacaacaacaacggggugaagggcuucuccuaccucgacggcgcgaacaccuggcuggggcggaccaucucgaccgccucccgcaguggcuacgagaugcugaaggugcccaacgcccucaccgacgaccgguccaagccgauccaggggcagacgaucguccugaacgccgacuggucgggcuacuccgggucguucauggacuacugggccgagggcgacuguuaccgcgcgugcuucuacguggagcugauccgcggccggcccaaggaggacaaggugcucuggaccggggacuccaucgucucgaugugcuccucgaccgaguuccugggccaguggaacuggcccgacggggccaagaucgaguacuuccuguga

SEQ ID NO: 25802 - RNA, 1398 nt, Artificial Sequence
  derived and/or modified CDS sequence (AUadapt) from InfluenzaA__AGJ72863__NA
augaaucccaaccagaagauccugugcaccucggccaccgccaucaucaucggcgcgaucgccgugcucaucgggaucgccaaccugggccugaacaucgggcuccaccugaagccgggcugcaacugcucccacucgcagcccgagacgaccaacaccucccagaccaucaucaacaauuacuacaacgagacgaacaucaccaacauccagauggaggagcgcaccucgcggaacuucaacaaccugaccaaggggcucugcacgaucaacuccuggcacaucuauggcaaggacaacgccguccgcaucggcgagucguccgacgugcuggugacccgggagcccuacgucucgugcgaccccgacgagugccgcuucuacgcccugucccaggggaccaccauccggggcaagcacaguaacgggacgauccacgaccgcucccaguaccgggcgcucaucucguggccgcuguccucgccgcccaccguguacaacucccgcguggagugcaucggcuggucguccaccucgugccacgaugggaagucccggaugucgaucugcaucucgggccccaacaacaacgccuccgccgucgugugguacaaccgccggcccguggccgagaucaacaccugggcgcgcaacauccugcggacgcaggagucggagugcgucugccacaauggcgugugccccguggucuucaccgacggguccgccaccggccccgccgacacccgcaucuacuacuucaaggaggggaagauccucaagugggagucgcugacgggcaccgccaagcacaucgaggagugcuccugcuacggcgagcggaccgggaucacgugcacgugucgcgacaacuggcagggcucgaaccggcccgugauccagaucgacccgguggccaugacccacaccucccaguacaucugcucgcccguccugaccgacaacccccgccccaacgacccgaauaucgggaagugcaacgaccccuaccccggcaacaacaacaacggggugaagggcuucuccuaccucgacggcgcgaacaccuggcuggggcggaccaucucgaccgccucccgcaguggcuacgagaugcugaaggugcccaacgcccucaccgacgaccgguccaagccgauccaggggcagacgaucguccugaacgccgacuggucgggcuacuccgggucguucauggacuacugggccgagggcgacuguuaccgcgcgugcuucuacguggaggugauccgcggccggcccaaggaggacaaggucuggugggccgggaacuccaucgugucgaugugcuccucgaccgaguuccugggccaguggaacuggcccgacggggccaagaucgaguacuuccucuga

SEQ ID NO: 25803 - RNA, 1410 nt, Artificial Sequence
  derived and/or modified CDS sequence (AUadapt) from InfluenzaA__AGJ73328__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacucgcgguucgaguccguggccuggagcgcguccgccugccacgacgggaucaacuggcucaccaucggcaucagcggccccgacuccggggccgucgccgugcugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucagcuucaaguacggcaacggggucuggaucggccgcaccaaguccaucucgucccggaagggcuucgagaugaucugggaccccaacggguggaacggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 25804 - RNA, 1410 nt, Artificial Sequence; identical to SEQ ID NO: 22659
  derived and/or modified CDS sequence (AUadapt) from InfluenzaA__AGJ73330__NA

SEQ ID NO: 25805 - RNA, 1410 nt, Artificial Sequence
  derived and/or modified CDS sequence (AUadapt) from InfluenzaA__AGJ73332__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccacaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucaucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 25806 - RNA, 1410 nt, Artificial Sequence; identical to SEQ ID NO: 22659
  derived and/or modified CDS sequence (AUadapt) from InfluenzaA__AGJ73334__NA

SEQ ID NO: 25807 - RNA, 1410 nt, Artificial Sequence; identical to SEQ ID NO: 22659
  derived and/or modified CDS sequence (AUadapt) from InfluenzaA__AGJ73336__NA

SEQ ID NO: 25808 - RNA, 1410 nt, Artificial Sequence; identical to SEQ ID NO: 22659
  derived and/or modified CDS sequence (AUadapt) from InfluenzaA__AGJ73338__NA

SEQ ID NO: 25809 - RNA, 1410 nt, Artificial Sequence
  derived and/or modified CDS sequence (AUadapt) from InfluenzaA__AGJ73340__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggccuccggcugggccaucuacagcaaggacaacuccauccgcaucggcagcaagggggacgucuucgugauccgggagcccuucaucuccugcucgccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccgucgcguggucggccuccgccugccacgacgggaucaacuggcucaccaucggcaucagcggccccgacaacggggccguggcggugcugaaguacaacggcaucaucaccgacaccaucaaguccuggcgcaacaacauccugcggacgcaggagagcgagugcgccugcgucaacggguccugcuucaccaucaugaccgacggcccgagcgacggccaggccuccuacaagaucuuccgcaucgagaaggggaagaucgucaagucgguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgugucguccaacggggccaacggcgucaagggguucagcuucaaguacggcaacgggguguggaucggccgcaccaagagcaucuccagccggaagggcuucgagaugaucugggaccccaacggguggaccggcaccgacaacaacuucuccaucaagcaggacaucguggggaucaacgaguggucgggcuacuccgggagcuucguccagcacccggagcugacgggccuggacugcauccgccccugcuucuggguggagcucauccggggccgccccaaggagaacaccaucuggaccuccgggagcuccaucagcuucugcggcgugaacuccgacaccgucggguggagcuggcccgacggcgcggagcugccguucacgaucgacaaguga

SEQ ID NO: 25810 - RNA, 1410 nt, Artificial Sequence
  derived and/or modified CDS sequence (AUadapt) from InfluenzaA__AGJ73342__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggucgggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgggaccgugggcuggagcuggcccgacggcgccgagcugccguucacgaucgacaaguga

SEQ ID NO: 25811 - RNA, 1410 nt, Artificial Sequence; identical to SEQ ID NO: 23111
  derived and/or modified CDS sequence (AUadapt) from InfluenzaA__AGJ73344__NA

SEQ ID NO: 25812 - RNA, 1410 nt, Artificial Sequence
  derived and/or modified CDS sequence (AUadapt) from InfluenzaA__AGJ73346__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagaagugcaaccagagcgucaucacguacgagaacaacaccugggugaaccagaccuacgugaacaucuccaacaccaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugucgugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggucgugcuucacgaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcucgugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacaucgucgggaucaacgagugguccggcuacucgggguccuucgugcagcacccggagcugaccggccuggacugcauccgccccugcuucuggguggagcucauccggggccgccccaaggagagcacgaucuggaccuccgggagcuccaucagcuucugcggcgucaacuccgacaccgugggguggagcuggcccgacggcgccgagcugccguucaccaucgacaaguga

SEQ ID NO: 25813 - RNA, 1410 nt, Artificial Sequence
  derived and/or modified CDS sequence (AUadapt) from InfluenzaA__AGJ73348__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucaucuccgugaagcuggccgggaacucgucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggucgugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaagggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 25814 - RNA, 1410 nt, Artificial Sequence
  derived and/or modified CDS sequence (AUadapt) from InfluenzaA__AGJ73350__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacgagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgugaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaagggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 25815 - RNA, 1410 nt, Artificial Sequence
  derived and/or modified CDS sequence (AUadapt) from InfluenzaA__AGJ73352__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggucgggaacuccagccucugcccgguguccggcugggccaucuacagcaaggacaacuccauccgcaucggcucgaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccguggccuggagcgccuccgcgugccacgacgggaucaacuggcucaccaucggcaucagcggccccgacaacggggccgucgccgugcugaaguacaacggcaucaucaccgacaccaucaaguccuggcgcaacaacauccugcggacgcaggagucggagugcgccugcgugaacggguccugcuucaccaucaugaccgacggcccgagcgacggccaggcguccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacuccccgcggcccaacgacaagaccggcagcugcggccccguguccucgaacggggccaacggcgugaagggguucagcuucaaguacggcaacggggucuggaucggccgcaccaaguccaucagcucccggaagggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 25816 - RNA, 1410 nt, Artificial Sequence; identical to SEQ ID NO: 23111
  derived and/or modified CDS sequence (AUadapt) from InfluenzaA__AGJ73354__NA

SEQ ID NO: 25817 - RNA, 1410 nt, Artificial Sequence
  derived and/or modified CDS sequence (AUadapt) from InfluenzaA__AGJ73356__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacuucaacaucagcaacacgaacuucgccgcgggccaguccguggucagcgugaagcuggccgggaacuccucgcucugcccgguguccggcugggccaucuacagcaaggacaacuccauccgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacucgcgguucgaguccgucgccuggagcgcguccgccugccacgacgggaucaacuggcucaccaucggcaucagcggccccgacaacggggccguggccgugcugaaguacaacggcaucaucaccgacaccaucaaguccuggcgcaacaacauccugcggacgcaggagagcgagugcgcgugcgucaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgugagcuccaacggggccaacggcgucaagggguucagcuucaaguacggcaacgggguguggaucggccgcaccaagagcaucuccucgcggaagggcuucgagaugaucugggaccccaacggguggaccggcaccgacaacaacuucuccaucaagcaggacaucguggggaucaacgaguggagcggcuacuccgggagcuucguccagcacccggagcugacgggccuggacugcauccgccccugcuucuggguggagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 25818 - RNA, 1410 nt, Artificial Sequence; identical to SEQ ID NO: 23111
  derived and/or modified CDS sequence (AUadapt) from InfluenzaA__AGJ73358__NA

SEQ ID NO: 25819 - RNA, 1410 nt, Artificial Sequence; identical to SEQ ID NO: 23111
  derived and/or modified CDS sequence (AUadapt) from InfluenzaA__AGJ73360__NA

SEQ ID NO: 25820 - RNA, 1410 nt, Artificial Sequence
  derived and/or modified CDS sequence (AUadapt) from InfluenzaA__AGJ73362__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgacggccaguccgucgugucggugaagcuggcggggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgccuccgcgugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgccugcgugaacggguccugcuucaccaucaugaccgacggcccgagcgacggccaggcguccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggucgggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 25821 - RNA, 1410 nt, Artificial Sequence; identical to SEQ ID NO: 24234
  derived and/or modified CDS sequence (AUadapt) from InfluenzaA__AGJ73364__NA

SEQ ID NO: 25822 - RNA, 1410 nt, Artificial Sequence; identical to SEQ ID NO: 23111
  derived and/or modified CDS sequence (AUadapt) from InfluenzaA__AGJ73366__NA

SEQ ID NO: 25823 - RNA, 1410 nt, Artificial Sequence; identical to SEQ ID NO: 22659
  derived and/or modified CDS sequence (AUadapt) from InfluenzaA__AGJ73370__NA

SEQ ID NO: 25824 - RNA, 1410 nt, Artificial Sequence
  derived and/or modified CDS sequence (AUadapt) from InfluenzaA__AGJ73372__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccacaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 25825 - RNA, 1410 nt, Artificial Sequence; identical to SEQ ID NO: 22659
  derived and/or modified CDS sequence (AUadapt) from InfluenzaA__AGJ73374__NA

SEQ ID NO: 25826 - RNA, 1410 nt, Artificial Sequence
  derived and/or modified CDS sequence (AUadapt) from InfluenzaA__AGJ73376__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccgugcgcaucggcagcaagggggacguguucgucauccgggagcccuucaucuccugcucgccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccguggccuggucggcguccgccugccacgacgggaucaacuggcucaccaucggcaucagcggccccgacuccggggccgucgccgugcugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccucguacaagauccuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcucgugcggccccguguccagcaacggggccaacggcgugaagggguucagcuucaaguacggcaacggggucuggaucggccgcaccaaguccaucagcucccggaagggcuucgagaugaucugggaccccaacggguggaccggcaccgacaacaacuucucgacgaagcaggacaucguggggaucaacgagugguccggcuacagcggguccuucgugcagcacccggagcugaccggccucgacugcauccgccccugcuucugggucgagcugauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 25827 - RNA, 1410 nt, Artificial Sequence
  derived and/or modified CDS sequence (AUadapt) from InfluenzaA__AGJ73379__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacucgcgguucgaguccguggccuggagcgcguccgccugccacgacgggaucaacuggcucaccaucggcaucagcggccccgacuccggggccgucgccgugcugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucagcuucaaguacggcaacggggucuggaucggccgcaccaaguccaucucgucccggaagggcuucgagaugaucugggaccccaacggguggaccggcaccgacaacaacuucagcaucaagcaggacaucaucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 25828 - RNA, 1410 nt, Artificial Sequence
  derived and/or modified CDS sequence (AUadapt) from InfluenzaA__AGJ73381__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacgagcacuccaacgggaccaucaaggaccggagccccuaccgcacgcugauguccugcccgaucggcgaggugcccagccccuacaacucgcgguucgaguccguggccuggagcgcguccgccugccacgacgggaucaacuggcucaccaucggcaucagcggccccgacuccggggccgucgccgugcugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucagcuucaaguacggcaacggggucuggaucggccgcaccaaguccaucucgucccggaagggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 25829 - RNA, 1410 nt, Artificial Sequence
  derived and/or modified CDS sequence (AUadapt) from InfluenzaA__AGK62992__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggucgaagccccagugcgacaucaccggguucgcgcccuucuccaaggacaacagcauccgccuguccgccggcggggacaucugggucacccgggagcccuacgugucgugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccucguccugccacgacgggaaggccuggcugcacgugugcaucaccggcgacgacaagaacgcgaccgccagcuucaucuacaacgggcggcucguggacuccguggucucgugguccaaggagauccugcgcacccaggagagcgagugcgugugcaucaacggcacgugcaccguggucaugaccgacggguccgccucgggcaaggccgacaccaagauccuguucaucgaggagggcaagaucgugcacacgagcacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcgggcacggggucaagggcugggccuucgacgacgggaacgacguguggaugggccgcaccaucaacgagacgucgcggcucggcuacgagaccuucaaggucaucgaggggugguccaaccccaagagcaagcugcagaucaaccgccaggugaucguggaccggggcgaccgcuccggguacucgggcaucuucuccgucgaggucaagagcugcaucaaccggugcuucuacguggagcugauccgcgggcggaaggaggagaccgaggugcucuggaccucgaacuccaucgugguguucugcggcacgagcggcaccuacgggaccggcuccuggcccgacggggccgacaucaaccugaugcccaucuga

SEQ ID NO: 25830 - RNA, 1410 nt, Artificial Sequence
  derived and/or modified CDS sequence (AUadapt) from InfluenzaA__AGK62996__NA
augaaccccaaccagaagaucaucaccaucggcucggugucccugaucaucagcaccaucugcuucuucaugcagaucgccauccucaucacgaccgucacccugcacuucaagcaguacgaguucaacuccccgcccaacaaccaggugaugcugugcgagcccaccaucaucgagcgcaacaucacggagaucguguaccucaccaacaccaccaucgagaaggagaucugccccaagccggccgaguaccggaacuggucgaagccccagugcgacaucacgggguucgcgcccuucuccaaggacaacagcauccgccuguccgccggcggggacaucugggucacccgggagcccuacgugucgugcgacccggacaagugcuaccaguucgcccugggccaggggaccacccucaacaacgugcacuccaacaacacgguccgcgaccggacccccuaccgcacccugcugaugaacgagcucggcgugcccuuccaccugggcaccaagcaggucugcaucgccuggagcuccucguccugccacgacgggaaggccuggcugcacgugugcaucacgggcgacgacaagaacgcgaccgccagcuucaucuacaacgggcggcucguggacuccguggucucgugguccaaggagauccugcgcacccaggagagcgagugcgugugcaucaacgggaccugcacgguggucaugaccgacggguccgccucgggcaaggccgacaccaagauccuguucaucgaggagggcaagaucgugcacaccagcacgcucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcggccacggggucaagggcugggccuucgacgacgggaacgacguguggaugggccgcaccaucaacgagaccucgcggcucggcuacgagacguucaaggucaucgaggggugguccaaccccaagagcaagcugcagaucaaccgccaggugaucguggaccggggcgaccgcuccggguacucgggcaucuucuccgucgagagcaagucgugcaucaaccggugcuucuacguggagcugauccgcgggcggaaggaggagaccgaggugcucuggaccuccaacagcaucgucguguucugcggcaccuccggcacguacgggaccggcagcuggcccgacggggccgacaucaaccugaugcccaucuga

SEQ ID NO: 25831 - RNA, 1410 nt, Artificial Sequence
  derived and/or modified CDS sequence (AUadapt) from InfluenzaA__AGK62998__NA
augaaccccaaccagaagaucaucaccaucggcucggugucccugaccaucgccacgaucugcuucuucaugcagaucgccauccucaucaccaccgucacccugcacuucaagcagugcgaguucaacagcccgcccaacaaccaggugaugcugugcgagcccacgaucaucgagcgcaacaucaccgagaucguguaccucaccaacaccacgaucgagaaggagaucugccccaagcuggcggaguaccggaacugguccaagccgcagugcgacaucaccggguucgcccccuucucgaaggacaacuccauccgccugagcgccggcggggacaucugggucacccgggagcccuacguguccugcgaccccgacaagugcuaccaguucgcccucggccaggggaccacgcugaacaacgugcacucgaacaacaccguccgcgaccggaccccguaccgcacccugcucaugaacgagcugggcgugcccuuccaccugggcacgaagcaggucugcauggccugguccagcuccucgugccacgacgggaaggcguggcuccacgugugcaucaccggcgacgacaagaacgccaccgccuccuucaucuacaacgggcggcugguggacagcguggucuccuggucgaaggagauccugcgcacccaggaguccgagugcgugugcaucaacggcacgugcaccguggucaugaccgacgggagcgccuccggcaaggcggacaccaagauccucuucaucgaggagggcaagaucgugcacacgucgacccugagcggguccgcccagcacguggaggagugcucgugcuacccccgguaccccggcguccgcugcgugugccgggacaacuggaagggguccaaccgcccgaucguggacaucaacaucaaggaccacagcaucgucuccucguacgugugcuccggccugcucggcgacacgccccggaagaacgacagcuccucguccagccacugccuggaccccaacaacgaggagggcgggcacggggugaagggcugggccuucgacgacgggaacgacgucuggaugggccgcaccaucuccgagaagucccggcugggcuacgagaccuucaaggugaucgagggguggucgaaccccaagagcaagcuccagaucaaccgccaggucaucguggaccggggcgaccgcuccggguacucgggcaucuucuccguggagagcaagucgugcaucaaccggugcuucuacgucgagcugauccgcgggcggaaggaggagaccgaggugcuguggaccuccaacagcaucguggucuucugcggcaccuccggcacguacgggaccggcagcuggccggacggggccgacaucaaccucaugcccaucuga

SEQ ID NO: 25832 - RNA, 1410 nt, Artificial Sequence
  derived and/or modified CDS sequence (AUadapt) from InfluenzaA__AGK63000__NA
augaaccccaaccagaagaucaucaccaucggcucggugucccugaccaucgccacgaucugcuucuucaugcagaucgccauccucaucaccaccgucacccugcacuucaagcagugcgacuucaacucgccgcccaacaaccaggugaugcugugcgagcccacgaucaucgagcgcaacaucaccgagaucguguaccucaccaacaccacgaucgagaaggagaucugccccaagcuggcggaguaccggaacugguccaagccgcagugcgacaucaccggguucgcccccuucagcaaggacaacuccauccgccugucggccggcggggacaucugggucacccgggagcccuacguguccugcgaccccgacaagugcuaccaguucgcccucggccaggggaccacgcugaacaacgugcacagcaacaacaccguccgcgaccggaccccguaccgcacccugcucaugaacgagcugggcgugcccuuccaccugggcacgaagcaggucugcauggccugguccucguccagcugccacgacgggaaggcguggcuccacgugugcaucaccggcgacgacaagaacgccaccgccuccuucaucuacaacgggaagcugguggacucgguggucuccuggagcaaggagauccugcggacccaggaguccgagugcgugugcaucaacggcacgugcaccguggucaugaccgacgggucggccuccggcaaggcggacaccaagauccucuucaucgaggagggcaagaucgugcacacgagcacccugucgggguccgcccagcacguggaggagugcucgugcuacccccgcuaccccggcguccggugcgugugccgcgacaacuggaagggguccaaccggccgaucguggacaucaacaucaaggaccacagcaucgucuccucguacgugugcuccggccuggugggcgacacgccccgcaagaacgacagcuccucguccagccacugccucgaccccaacaacgaggagggcgggcacggggucaagggcugggccuucgacgacgggaacgacguguggaugggccggaccaucaacgagaccucccgccugggcuacgagaccuucaaggucaucgagggguggucgaaccccaaguccaagcugcagaucaaccgccaggugaucguggaccggggcgaccggagcggguacuccggcaucuucucggucgaggggaaguccugcaucaaccgcugcuucuacguggagcucauccggggccgcaaggaggagaccgaggugcuguggaccagcaacucgaucgucguguucugcggcacguccgggaccuacggcaccgggagcuggccggacggcgccgacaucaaccugaugcccaucuga

SEQ ID NO: 25833 - RNA, 1410 nt, Artificial Sequence
  derived and/or modified CDS sequence (AUadapt) from InfluenzaA__AGK63002__NA
augaaccccaaccagaagaucaucaccaucggcucggugucccugaccaucagcacgaucugcuucuucaugcagaucgccauccucaugaccaccgucacccugcacuucaagcagugcgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcauggccuggagcuccucguccugccacgacgggaaggccuggcuccacgugugcaucaccggcaacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaccgagaccucgcggcugggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcucauccgcgggcggaaggaggagaccgaggugcuguggacgucgaacuccaucgucguguucugcggcaccagcgggaccuacggcaccggguccuggccggacggcgccgacaucaaccugaugcccaucuga

SEQ ID NO: 25834 - RNA, 1410 nt, Artificial Sequence
  derived and/or modified CDS sequence (AUadapt) from InfluenzaA__AGK63004__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggagcucccagcacguggaggagugcucgugcuacccccgguacccgggcguccgcugcgugugccgggacaacuggaagggguccaaccgccccaucguggacaucaacaucaaggaccacagcaucgucuccucguacgugugcuccggccuggugggcgacacgccccggaagaacgacagcuccucguccagccacugccuggaccccaacaacgaggagggcgggcacggggucaagggcugggcguucgacgacgggaacgacguguggaugggccgcaccaucaacgagaccucccggcucggcuacgagaccuucaaggucaucgagggguggucgaacccgaaguccaagcugcagaucaaccgccaggugaucguggaccggggcgaccgcagcggguacuccggcaucuucucggucgagggcaagagcugcaucaaccggugcuucuacguggagcugauccgcgggcggaaggaggagaccgaggugcucuggaccuccaacucgaucgucguguucugcggcacguccgggaccuacggcaccgggagcuggcccgacggcgccgacaucaaccugaugcccaucuga

SEQ ID NO: 25835 - RNA, 1410 nt, Artificial Sequence
  derived and/or modified CDS sequence (AUadapt) from InfluenzaA__AGK63006__NA
augaaccccaaccagaagaucaucaccaucggcucggugucccugaccaucgccacgaucugcuucuucaugcagaucgccauccucaucaccaccgucacccugcacuucaagcaguacgaguucaacucgccgcccaacaaccaggugaugcugugcgagcccacgaucaucgagcgcaacaucaccgagaucguguaccucaccaacaccacgaucgagaaggagaucugccccaagccggcggaguaccggaacugguccaagccccagugcgacaucaccggguucgcccccuucagcaaggacaacuccauccgccugucggccggcggggacaucugggucacccgggagcccuacguguccugcgacccggacaagugcuaccaguucgcccugggccaggggaccacgcucaacaacgugcacagcaacaacaccguccgcgaccggacccccuaccgcacccugcugaugaacgagcucggcgugcccuuccaccugggcacgaagcaggucugcaucgccugguccucguccagcugccacgacgggaaggcguggcugcacgugugcaucaccggcgacgacaagaacgccaccgccuccuucaucuacaacgggcggcucguggacucgguggucuccuggagcaaggagauccugcgcacccaggaguccgagugcgugugcaucaacggcacgugcaccguggucaugaccgacgggucggccuccgcgaaggccgacaccaagauccuguucaucgaggagggcaagaucgugcacacgagcacccucucgggcuccgcccagcacguggaggagugcagcugcuacccccgguacuccgggguccgcugcgugugccgggacaacuggaagggcucgaaccgcccgaucguggacaucaacaucaaggaccacuccaucgucagcuccuacgugugcucggggcuggugggcgacacgccccggaagaacgacuccagcuccucgucccacugccuggaccccaacaacgaggagggcgggcacggcgucaaggggugggccuucgacgacggcaacgacguguggauggggcgcaccaucaacgagaccagccggcucggcuacgagaccuucaaggucaucgagggcugguccaaccccaagucgcagcugcagaucaaccgccaggugaucguggaccgcggggaccgguccggcuacagcgggaucuucuccgucgagucgaagagcugcaucaaccggugcuucuacguggagcugauccgcggccggaaggaggagaccgaggugcucuggaccuccaacucgaucgucguguucugcgggacguccggcaccuacggcaccgggagcuggccggacggcgccgacaucaaccugaugcccaucuga

SEQ ID NO: 25836 - RNA, 1410 nt, Artificial Sequence
  derived and/or modified CDS sequence (AUadapt) from InfluenzaA__AGK63008__NA
augaaccccaaccagaagaucaucaccaucggcucggugucccugaccaucgccacgaucugcuucuucaugcagaucgccauccucaucaccaccgucacccugcacuucaagcagugcgaguucaacucgccgcccaacaaccaggugaugcugugcgagcccacgaucaucgagcgcaacaucaccgagaucguguaccucaccaacaccacgaucgagaaggagaucugccccaagcuggcggaguaccggaacugguccaagccgcagugcgacaucaccggguucgcccccuucagcaaggacaacuccauccgccugucggccggcggggacaucugggucacccgggagcccuacguguccugcgaccccgacaagugcuaccaguucgcccucggccaggggaccacgcugaacaacgugcacagcaacaacaccguccgcgaccggaccccguaccgcacccugcucaugaacgagcugggcgugcccuuccaccugggcacgaagcaggucugcauggccugguccucguccagcugccacgacgggaaggcguggcuccacgugugcaucaccggcgacgacaagaacgccaccgccuccuucaucuacaacgggaagcugguggacucgguggucuccuggagcaaggagauccugcggacccaggaguccgagugcgugugcaucaacggcacgugcaccguggucaugaccgacgggucggccuccggcaaggcggacaccaagauccucuucaucgaggagggcaagaucgugcacacgagcacccugucgggguccgcccagcacguggaggagugcucgugcuacccccgcuaccccggcguccggugcgugugccgcgacaacuggaagggguccaaccggccgaucguggacaucaacaucaaggaccacagcaucgucuccucguacgugugcuccggccuggugggcgacacgccccgcaagaacgacagcuccucguccagccacugccucgaccccaacaacgaggagggcgggcacggggucaagggcugggccuucgacgacgggaacgacguguggaugggccggaccaucaacgagaccucccgccugggcuacgagaccuucaaggucaucgagggguggucgaaccccaaguccaagcugcagaugaaccgccaggugaucguggaccggggcgaccggagcggguacuccggcaucuucucggucgaggggaaguccugcaucaaccgcugcuucuacguggagcucauccggggccgcaaggaggagaccgaggugcuguggaccagcaacucgaucgucguguucugcggcacguccgggaccuacggcaccgggagcuggccggacggcgccgacaucaaccugaugcccaucuga

SEQ ID NO: 25837 - RNA, 1410 nt, Artificial Sequence
  derived and/or modified CDS sequence (AUadapt) from InfluenzaA__AGK63010__NA
augaaccccaaccagaagaucaucaccaucggcucggugucccugaccaucgccacgaucugcuucuucaugcagaucgccauccucaucaccaccgucacccugcacuucaagcagugcgaguucaacucgccgcccaacaaccaggugaugcugugcgagcccacgaucaucgagcgcaacaucaccgagaucguguaccucaccaacaccacgaucgagaaggagaucugccccaagcuggcggaguaccggaacugguccaagccgcagugcgacaucaccggguucgcccccuucagcaaggacaacuccauccgccugucggccggcggggacaucugggucacccgggagcccuacguguccugcgaccccgacaagugcuaccaguucgcccucggccaggggaccacgcugaacaacgugcacagcaacaacaccguccgcgaccggaccccguaccgcacccugcucaugaacgagcugggcgugcccuuccaccugggcacgaagcaggucugcauggccugguccucguccagcugccacgacgggaaggcguggcuccacgugugcaucaccggcgacgacaagaacgccaccgccuccuucaucuacaacgggaagcugguggacucgguggucuccuggagcaaggagauccugcggacccaggaguccgagugcgugugcaucaacggcacgugcaccguggucaugaccgacgggucggccuccggcaaggcggacaccaagauccucuucaucgaggagggcaagaucgugcacacgagcacccugucgggguccgcccagcacguggaggagugcucgugcuacccccgcuaccccggcguccggugcgugugccgcgacaacuggaagggguccaaccggccgaucguggacaucaacaucaaggaccacagcaucgucuccucguacgugugcuccggccuggugggcgacacgccccgcaagaacgacagcuccucguccagccacugccucgaccccaacaacgaggagggcgggcacggggucaagggcugggccuucgacgacgggaacgacguguggaugggccggaccaucaacgagaccucccgccugggcuacgagaccuucaaggucaucgagggguggucggaccccaaguccaagcugcagaucaaccgccaggugaucguggaccggggcgaccggagcggguacuccggcaucuucucggucgaggggaaguccugcaucaaccgcugcuucuacguggagcucauccggggccgcaaggaggagaccgaggugcuguggaccagcaacucgaucgucguguucugcggcacguccgggaccuacggcaccgggagcuggccggacggcgccgacaucaaccugaugcccaucuga

SEQ ID NO: 25838 - RNA, 1410 nt, Artificial Sequence
  derived and/or modified CDS sequence (AUadapt) from InfluenzaA__AGK63012__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggucgaagccccagugcgacaucaccggguucgcgcccuucuccaaggacaacagcauccgccuguccgccggcggggacaucugggucacccgggagcccuacgugucgugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccucguccugccacgacgggaaggccuggcugcacgugugcaucaccggcgacgacaagaacgcgaccgccagcuucaucuacaacgggcggcucguggacuccguggucucgugguccaaggagauccugcgcacccaggagagcgagugcgugugcaucaacggcacgugcaccguggucaugaccgacggguccgccucgggcaaggccgacaccaagauccuguucaucgaggagggcaagaucgugcacacgagcacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcgggcacggggucaagggcugggccuucgacgacgggaacgacguguggaugggccgcaccaucaacgagacgucgcggcucggcuacgagaccuucaaggucaucgaggggugguccaaccccaagagcaagcugcagaucaaccgccaggugaucguggaccggggcuaccgcuccggguacucgggcaucuucuccgucgagggcaagagcugcaucaaccggugcuucuacguggaccugauccgcgggcggaaggaggagaccgaggugcucuggaccucgaacuccaucgucguguucugcggcacgagcgggaccuacggcaccggguccuggcccgacggcgccgacaucaaccugaugcccaucuga

SEQ ID NO: 25839 - RNA, 1410 nt, Artificial Sequence
  derived and/or modified CDS sequence (AUadapt) from InfluenzaA__AGK63014__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuucccccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucucgugguccaaggagauccaccgcacccaggagagcgagugcgugugcaucaacggcacgugcaccguggucaugaccgacggguccgccucgggcaaggccgacaccaagauccuguucaucgaggagggcaagaucgugcacacgagcacccuguccgggucggcgcagcacguggaggagugcuccugcuacccgcgguaccccggcguccgcugcgugugccgggacaacuggaaggggagcaaccgccccaucguggacaucaacaucaaggaccacuccaucgucucguccuacgugugcagcggccucgugggcgacacgccccggaagaacgacuccucguccucgucccacugccuggacccgaacaacgaggagggcgggcacggggucaagggcugggccuucgacgacgggaacgacguguggaugggccgcaccaucagcgagaagucccggcugggcuacgagaccuucaaggucaucgagggguggucgaaccccaaguccaagcuccagaucaaccgccaggugaucguggaccggggcaaccgcagcggguacuccggcaucuucucggucgagggcaagagcugcaucaaccggugcuucuacguggagcugauccgcgggcggaaggaggagaccgaggugcuguggaccuccaacucgaucgucguguucugcggcaccuccgggacguacggcaccgggagcuggcccgacggcgccgacaucaaccucaugcccaucuga

SEQ ID NO: 25840 - RNA, 1410 nt, Artificial Sequence
  derived and/or modified CDS sequence (AUadapt) from InfluenzaA__AGK63018__NA
augaaccccaaccagaagaucaucaccaucggcucggugucccugaccaucagcacgaucugcuucuucaugcagaucgccauccucaucaccaccgucacccugcacuucaagcagugcgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcauggccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcugcagaucaaccgccaggugaucguggaccggggcgaccgguccggguacucgggcaucuucuccgucgagggcaagagcugcaucaaccgcugcuucuacguggagcucauccgggggcgcaaggaggagaccgaggugcuguggaccucgaacuccaucgucguguucugcggcacgagcgggaccuacggcaccggguccuggccggacggcgccgacaucaaccugaugcccaucuga

SEQ ID NO: 25841 - RNA, 1410 nt, Artificial Sequence
  derived and/or modified CDS sequence (AUadapt) from InfluenzaA__AGK63020__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcgggcacggggucaagggcugggccuucgacgacgggaacgacguguggaugggccgcaccaucaacgagacgucgcggcucggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgacaucaaccugaugcccaucuga

SEQ ID NO: 25842 - RNA, 1410 nt, Artificial Sequence
  derived and/or modified CDS sequence (AUadapt) from InfluenzaA__AGK63022__NA
augaaccccaaccagaagaucaucaccaucggcucggugucccugaccaucagcacgaucugcuucuucaugcagaucgccauccucaucaccaccgucacccugcacuucaagcagugcgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcauggccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcugcagaucaaccgccaggugaucguggaccggggcgaccgguccggguacucgggcaucuucuccgucgagggcaagagcugcaucaaccgcugcuucuacguggaccucauccgggggcgcaaggaggagaccgaggugcuguggaccucgaacuccaucgucguguucugcggcacgagcgggaccuacggcaccggguccuggccggacggcgccgacaucaaccugaugcccaucuga

SEQ ID NO: 25843 - RNA, 1410 nt, Artificial Sequence; identical to SEQ ID NO: 25841
  derived and/or modified CDS sequence (AUadapt) from InfluenzaA__AGK63024__NA

SEQ ID NO: 25844 - RNA, 1410 nt, Artificial Sequence; identical to SEQ ID NO: 25841
  derived and/or modified CDS sequence (AUadapt) from InfluenzaA__AGK63026__NA

SEQ ID NO: 25845 - RNA, 1410 nt, Artificial Sequence
  derived and/or modified CDS sequence (AUadapt) from InfluenzaA__AGK63028__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaagaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagguggugcacacgucgacccucuccgggucggcgcagcacgucgaggagugcuccugcuacccccgguacccgggcgugcgcugcgugugccgggacaacuggaaggggagcaaccgccccaucgucgacaucaacaucaaggaccacuccaucgugucguccuacgugugcagcggccuggucggcgacaccccgcggaagaacgacuccucguccagcucccacugccuggaccccaacaacgaggagggcgggcacggggugaagggcugggccuucgacgacgggaacgacgucuggaugggccgcaccaucaacgagacgucgcggcucggcuacgagaccuucaaggugaucgaggggugguccaaccccaagagcaagcugcagaucaaccgccaggugaucgucgaccggggcgaccgcuccggguacucgggcaucuucuccguggaggccaagagcugcaucauccggugcuucuacguggagcugauccgcgggcggaaggaggagaccgagguccucuggaccucgaacuccaucgugguguucugcggcacgagcggcaccuacgggaccggcuccuggcccgacggggccgacaucaaccugaugcccaucuga

SEQ ID NO: 25846 - RNA, 1410 nt, Artificial Sequence; identical to SEQ ID NO: 25840
  derived and/or modified CDS sequence (AUadapt) from InfluenzaA__AGK63030__NA

SEQ ID NO: 25847 - RNA, 1410 nt, Artificial Sequence
  derived and/or modified CDS sequence (AUadapt) from InfluenzaA__AGK63032__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcauggccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucaccgagaccucgcgccugggcuacgagaccuucaaggucaucgaggggugguccaaccccaagagcaagcugcagaucaaccgccaggugaucguggaccggggcaaccgguccggguacucgggcaucuucuccgucgagggcaagagcugcaucaaccgcugcuucuacguggagcucauccgggggcgcaaggaggagaccgaggugcuguggacgucgaacuccaucgucguguucugcggcaccagcgggaccuacggcaccggguccuggccggacggcgccgacaucaaccugaugcccaucuga

SEQ ID NO: 25848 - RNA, 1410 nt, Artificial Sequence
  derived and/or modified CDS sequence (AUadapt) from InfluenzaA__AGK63034__NA
augaaccccaaccagaagaucaucaccaucggcucggugucccugaccaucagcacgaucugcuucuucaugcagaucgccauccucaucaccaccgucacccugcacuucaagcagugcgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcauggccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggucgaaccggccgaucguggacaucaacaucaagguccacuccaucgugagcuccuacgugugcucgggccuggucggcgacacgccccgcaagaacgacuccagcuccucgucccacugccucgaccccaacaacgaggagggcgggcacggggugaagggcugggccuucgacgacgggaacgacgucuggaugggccggaccaucaacgagaccagccgccugggcuacgagaccuucaaggugaucgaggggugguccaaccccaagucgaagcugcagaucaaccgccaggugaucgucgaccggggcgaccgguccggguacagcggcaucuucuccguggagggcaagucgugcaucaaccgcugcuucuacguggagcucauccgggggcgcaagaaggagaccgagguccuguggaccagcaacuccaucgugguguucugcggcacgagcgggaccuacggcaccggguccuggccggacggcgccgacaucaaccugaugcccaucuga

SEQ ID NO: 25849 - RNA, 1410 nt, Artificial Sequence
  derived and/or modified CDS sequence (AUadapt) from InfluenzaA__AGK63036__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcgggcacggggucaagggcugggccuucgacgacgggaacgacguguggaugggccgcaccaucaacgagacgucgcgguucggcuacgagaccaucaaggucaucgaggggugguccaaccccaagagcaaccuccagaucaaccgccaggugaucguggaccggggcaaccgcuccggguacucgggcaucuucuccgucgagggcaagagcugcaucaaccggugcuucuacguggagcugauccgcgggcggaaggaggagaccgaggugcuguggaccucgaacuccaucgucguguucugcggcacgagcgggaccuacggcaccggguccuggcccgacggcgccgacaucaaccucaugcccaucuga

SEQ ID NO: 25850 - RNA, 1410 nt, Artificial Sequence
  derived and/or modified CDS sequence (AUadapt) from InfluenzaA__AGK63038__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcauggccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggggaccacggcgucaaggggugggccuucgacgacggcaacgacguguggauggggcggaccaucaacgagaccucgcgccugggcuacgagaccuucaaggucaucgagggcugguccaaccccaagagcaagcugcagaucaaccgccaggugaucguggaccgggggaaccgguccggcuacucggggaucuucuccgucgagagcaagucgugcaucaaccgcugcuucuacguggagcucauccggggccgcaaggaggagaccgaggugcuguggaccuccaacagcaucgucguguucugcgggacguccggcaccuacggcaccgggagcuggccggacggcgccgacaucaaccugaugcccaucuga

SEQ ID NO: 25851 - RNA, 1410 nt, Artificial Sequence
  derived and/or modified CDS sequence (AUadapt) from InfluenzaA__AGK63040__NA
augaaccccaaccagaagaucaucaccaucggcucggugucccugaccaucagcacgaucugcuucuucaugcagaucgccauccucaucaccaccgucacccugcacuucaagcagugcgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcauggccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcugcagaucaaccgccaggugaucguggaccggggcgaccgguccggguacucgggcaucuucuccgucgagggcaagagcugcaucaaccgcugcuucuacguggagcucauccgggggcgcaaggaggagaccgaggugcuguggaccucgaacuccaucgucguguucugcggcacgagcgggaccuacggcaccggguccuggccggacggcgccgacaucaaccugaugcccaucuga

SEQ ID NO: 25852 - RNA, 1410 nt, Artificial Sequence
  derived and/or modified CDS sequence (AUadapt) from InfluenzaA__AGK63042__NA
augaaccccaaccagaagaucaucaccaucggcucggugucccugaccaucucgacgaucugcuucuucaugcagaucgccauccucaucaccaccgucacccugcacuucaagcagugcgaguucaacccgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgcccuucagcaaggacaacuccauccgccugucggccggcggggacaucugggucacccgggagcccuacguguccugcgacccggacaagugcuaccaguucgcccucggccaggggaccacgcugaacaacgugcacagcaacaacaccguccgcgaccggacccccuaccgcacccugcucaugaacgagcugggcgugcccuuccaccugggcacgaagcaggucugcauggccugguccucguccagcugccacgacgggaaggccuggcuccacgugugcaucaccggcgacgacaagaacgcgaccgccuccuucaucuacaacgggaagcugguggacucgguggucuccuggagcaaggagauccugcggacccaggaguccgagugcgugugcaucaacggcacgugcaccguggucaugaccgacgggucggccuccggcaaggccgacaccaagauccucuucaucgaggagggcaagaucgugcacacgagcacccugucgggguccgcgcagcacguggaggagugcucgugcuacccccgcuacccgggcguccggugcgugugccgcgacaacuggaagggguccaaccggcccaucguggacaucaacaucaaggaccacagcaucgucuccucguacgugugcuccggccuggugggcgacacgccccgcaagaacgacagcuccucguccagccacugccucgaccccaacaacgaggagggcgggcacggggucaagggcugggccuucgacgacgggaacgacguguggaugggccggaccaucaacgagaccucccgccugggcuacgagaccuucaaggucaucgagggguggucgaacccgaaguccaagcugcagaucaaccgccaggugaucguggaccggggcgaccggagcggguacuccggcaucuucucggucgaggggaaguccugcaucaaccgcugcuucuacguggagcucauccggggccgcaaggaggagaccgaggugcuguggaccagcaacucgaucgucguguucugcggcacguccgggaccuacggcaccgggagcuggcccgacggcgccgacaucaaccugaugcccaucuga

SEQ ID NO: 25853 - RNA, 1410 nt, Artificial Sequence
  derived and/or modified CDS sequence (AUadapt) from InfluenzaA__AGK63044__NA
augaaccccaaccagaagaucaucaccaucggcucggugucccugaccaucagcacgaucugcuucuucaugcagaucgccauccucaucaccaccgucacccugcacuucaagcagugcgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcauggccuggagcuccucguccugccacgacgggaaggccuggcuccacgugugcaucaccggcgacgacaagaacgcgaccgccagcuucaucuacaacgggaagcugguggacuccguggucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggaccacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcugcagaucaaccgccaggugaucguggaccggggcuaccgguccggguacucgggcaucuucuccgucgagagcaagucgugcaucaaccgcugcuucuacguggagcuccugcgggggcgcaaggaggagaccgaggugcuguggaccuccaacagcaucgucguguucugcggcacguccggcaccuacgggaccggcagcuggccggacggggccgacaucaaccucaugcccaucuga

SEQ ID NO: 25854 - RNA, 1410 nt, Artificial Sequence
  derived and/or modified CDS sequence (AUadapt) from InfluenzaA__AGK63046__NA
augaaccccaaccagaagaucaucaccaucggcucggugucccugaccaucucgacgaucugcuucuucaugcagaucgccauccucaucaccaccgucacccugcacuucaagcacuacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcgggcacggggucaagggcugggccuucgacgacgggaacgacguguggaugggccgcaccaucaacgagacgucgcggcucggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggaccugauccgcgggcggaaggaggagaccgaggugcucuggaccucgaacuccaucgucguguucugcggcacgagcgggaccuacggcaccggguccuggcccgacggcgccgacaucaaccugaugcccaucuga

SEQ ID NO: 25855 - RNA, 1398 nt, Artificial Sequence
  derived and/or modified CDS sequence (AUadapt) from InfluenzaA__AGK82159__NA
augaaucccaaccagaagauccugugcaccucggccaccgccaucaucaucggcgcgaucgccgugcucaucgggaucgccaaccugggccugaacaucgggcuccaccugaagccgggcugcaacugcucccacucgcagcccgagacgaccaacaccucccagaccaucaucaacaacuauuacaacgagacgaacaucaccaacauccagauggaggagcgcaccucgcggaacuucaacaaccugaccaaggggcucugcacgaucaacuccuggcacaucuacggcaaggacaacgccguccgcaucggcgagaguuccgacgugcuggugacccgggagcccuacgucucgugcgaccccgacgagugccgcuucuacgcccugucccaggggaccaccauccggggcaagcacucgaacgagacgauccacgaccgcucccaguaccgggcgcucaucaguuggccgcuguccucgccgcccaccguguacaacucccgcguggagugcaucggguggucguccaccucgugccacgacggcaagucccggaugucgaucugcaucucggggcccaacaacaacgccuccgccgucgugugguauaaccgccggcccguggccgagaucaacaccugggcgcgcaacauccugcggacgcaggagucggagugcgucugccacaacggcgugugccccguggucuucaccgacggcuccgccaccgggcccgccgacacccgcaucuacuacuucaaggagggcaagauccucaagugggagagucugacggggaccgccaagcacaucgaggagugcuccugcuacggcgagcggaccggcaucacgugcacgugccgcgacaacuggcaggggucgaaccggcccgugauccagaucgacccgguggccaugacccacaccucccaguacaucugcucgcccguccugaccgauaacccccgccccaacgacccgaacaucggcaagugcaacgaccccuaccccgggaacaacaacaacggcgugaagggguucuccuaccucgacggcgcgaauaccuggcugggccggaccaucucgaccgccucccgcucgggguacgagaugcugaaggugcccaacgcccucaccgacgaccgguccaagccgauccagggccagacgaucguccugaacgccgacuggucgggguacuccggcucguucauggacuacugggccgagggggacuguuaccgcgcgugcuucuacguggagcugauccgcggccggcccaaggaggacaaggugugguggaccuccaacucgaucgucuccaugugcucgucgaccgaguuccucggccaguggaacuggcccgacggggccaagaucgaguacuuccuguga

SEQ ID NO: 25856 - RNA, 1398 nt, Artificial Sequence; identical to SEQ ID NO: 16294
  derived and/or modified CDS sequence (AUadapt) from InfluenzaA__AGK84858__NA

SEQ ID NO: 25857 - RNA, 1398 nt, Artificial Sequence
  derived and/or modified CDS sequence (AUadapt) from InfluenzaA__AGK84861__NA
augaaucccaaccagaagauccugugcaccucggccaccgccaucaucaucggcgcgaucgccgugcucaucgggaucgccaaccugggccugaacaucgggcuccaccugaagccguccugcaacugcucgcacucccagcccgagacgaccaacaccucgcagaccaucaucaacaacuacuacaacgagacgaacaucaccaauauccagauggaggagcgcaccucccggaacuucaacaaccugaccaagggccucugcacgaucaacucguggcacaucuacgggaaggacaacgccguccgcaucggcgaguccucggacgugcuggugacccgggagcccuacgucuccugcgaccccgacgagugccgcuucuaugcccugucgcagggcaccaccauccgggggaagcacuccaacggcacgauccacgaccgcucgcaguaccgggcgcucaucuccuggccgcugucguccccgcccaccguguacaacucgcgcguggagugcaucgggugguccucgaccuccugccacgacggcaagucgcggaugucgaucugcaucuccgggcccaauaacaacgccucggccgucgugugguacaaccgccggcccguggccgagaucaacaccugggcgcgcaacauccugcggacgcaggaguccgagugcgucugccacaacggcgugugccccguggucuucaccgacggcucggccaccgggcccgccgacacccgcaucuacuacuucaaggagggcaagauccucaagugggagucccugacggggaccgccaagcacaucgaggaguguucgugcuacggcgagcggaccggcaucacgugcacgugccgcgacaacuggcagggguccaaccggcccguggugcagaucgacccggucgccaugacccacaccucgcaguacaucugcucccccgugcugaccgacaacccccgccccaacgacccgaacaucggcaagugcaaugaccccuaccccgggaucaacaacaacggcgugaagggguucucguaccucgacggcgcgaacaccuggcugggccggaccaucuccaccgccucgcgcuccggguacgagaugcugaagguccccaacgcccucaccgacgaccggucgaagccgauccagggccagacgaucgugcugaacgccgacugguccggguacaguggcuccuucauggacuacugggccgagggggacugcuaccgcgcgugcuucuacguggagcugauccgcggccggcccaaggaggacaaggucugguggaccucgaacuccaucgugucgaugugcucguccaccgaguuccucggccaguggaacuggcccgacggggccaagaucgaguacuuccuguga

SEQ ID NO: 25858 - RNA, 1398 nt, Artificial Sequence; identical to SEQ ID NO: 16294
  derived and/or modified CDS sequence (AUadapt) from InfluenzaA__AGK84864__NA

SEQ ID NO: 25859 - RNA, 1398 nt, Artificial Sequence
  derived and/or modified CDS sequence (AUadapt) from InfluenzaA__AGL95090__NA
augaaucccaaccagaagauccugugcaccucggccaccgccaucaucaucggcgcgaucgccgugcucaucgggaucgccaaccugggccugaacaucgggcuccaccugaagccgggcugcaacugcucccacucgcagcccgagacgaccaacaccucccagaccaucaucaacaacuacuauaacgagacgaacaucaacaacauccagauggaggagcgcaccucgcggaacuucaacaaccugaccaaggggcucugcaccaucaacuccuggcacaucuacggcaaggacaacgccguccgcaucggcgagaguuccgacgugcuggugacgcgggagcccuacgucucgugcgaccccgacgagugccgcuucuacgcccugucccaggggaccaccauccggggcaagcacucgaacgggaccauccacgaccgcucccaguaccgggcgcucaucaguuggccgcuguccucgccgcccacgguguacaacucccgcguggagugcaucggcuggucguccaccucgugccacgacgggaagucccggaugucgaucugcaucucgggccccaacaacaacgccuccgccgucgugugguauaaccgccggcccguggccgagaucaacaccugggcgcgcaacauccugcggacccaggagucggagugcgucugccacaacggcgugugccccguggucuucacggacggguccgccaccggccccgccgacacccgcaucuacuacuucaaggaggggaagauccucaagugggagagucugaccggcacggccaagcacaucgaggagugcuccugcuacggcgagcggaccgggaucacgugcacgugcaaggacaacuggcagggcucgaaccgccccgugauccagaucgacccgguggccaugacccacaccucccaguacaucugcucgcccguccugaccgauaacccccggcccaacgacccgaacaucgggaagugcaacgaccccuaccccggcaacaacaacaacggggugaagggcuucuccuaccucgacggcgcgaauaccuggcuggggcgcaccaucucgaccgccucccggucgggcuacgagaugcugaaggugcccaacgcccucaccgacgaccgcuccaagccgauccaggggcagaccaucguccugaacgccgacuggucgggcuacuccgggucguucauggacuacugggccgagggcgacuguuaccgggcgugcuucuacguggagcugauccgcggccgccccaaggaggacaaggugugguggacguccaacucgaucgucuccaugugcucgucgaccgaguuccucgggcaguggaacuggcccgacggcgccaagaucgaguacuuccuguga

SEQ ID NO: 25860 - RNA, 1413 nt, Artificial Sequence; identical to SEQ ID NO: 19034
  derived and/or modified CDS sequence (AUadapt) from InfluenzaA__AGL96802__NA

SEQ ID NO: 25861 - RNA, 1413 nt, Artificial Sequence; identical to SEQ ID NO: 19034
  derived and/or modified CDS sequence (AUadapt) from InfluenzaA__AGL96807__NA

SEQ ID NO: 25862 - RNA, 1413 nt, Artificial Sequence
  derived and/or modified CDS sequence (AUadapt) from InfluenzaA__AGL96808__NA
augaaccccaaccagaagaucaucaccaucggcucgaucuccaucgccaucgggaucaucagccugaugcuccagaucggcaacaucaucuccaucugggccagccacuccauccagaccgggucgcagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucucgggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagucgaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucucguacaaguacgacaacggcguguggaucgggcgcacgaaguccaaccggcugcgcaagggcuucgagaugaucugggaccccaacggguggaccaacaccgacagcuucuucuccgugaagcaggacgucguggccaucaccgacuggagcggcuacucgggguccuucgugcagcaccccgagcucacgggccuggacugcauccggcccugcuucugggucgagcuggugcgcggccucccgcgggagaacaccaccaucuggaccagcggguccagcaucuccuucugcggcgucaacagcgacacggccaacugguccuggcccgacggggccgagcugcccuucaccaucgacaaguga

SEQ ID NO: 25863 - RNA, 1413 nt, Artificial Sequence
  derived and/or modified CDS sequence (AUadapt) from InfluenzaA__AGL96809__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacaagaccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugacgguggacggcgccaacggggucaagggcuucagcuacaaguacgacaacggcguguggaucgggcgcaccaaguccaaccggcugcgcaagggcuucgagaugaucugggaccccaacggguggaccaacaccgacucggacuucuccgugaagcaggacgucguggcgaucacggacuggagcggcuacagcggguccuucgugcagcaccccgagcucaccggccuggacugcauccggcccugcuucugggucgagcuggugcgcggccucccgcgggagaacaccaccaucuggacgucgggguccagcaucuccuucugcggcgucaacagcgacaccgccaacugguccuggcccgacggggccgagcugcccuucaccaucgacaaguga

SEQ ID NO: 25864 - RNA, 1413 nt, Artificial Sequence; identical to SEQ ID NO: 19034
  derived and/or modified CDS sequence (AUadapt) from InfluenzaA__AGL96818__NA

SEQ ID NO: 25865 - RNA, 1413 nt, Artificial Sequence
  derived and/or modified CDS sequence (AUadapt) from InfluenzaA__AGL96820__NA
augaaccccaaccagaagaucaucaccaccggcucgaucuccaucgccaucgggaucaucagccugaugcuccagaucggcaacaucaucuccaucugggccucgcacuccauccagacggggagccagaacaacaccggcaucugcaaccagcgcaucaucaccuacgagaacuccaccugggugaaccacacguacgucaacaucaacaacaccaacgugguggcgggggaggacaagaccucggucacccuggccggcaacuccagccugugcuccaucagcggcugggccaucuacacgaaggacaacuccauccggaucgggucgaagggcgacguguucgugauccgcgagccguucaucuccugcagccaccucgagugccggaccuucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucacgaucgggaucagcggccccgacaacggggcgguggccguccugaaguacaacggcaucaucaccggcaccaucaaguccuggaagaagcagauccugcgcacccaggagucggagugcgugugcaugaacggguccugcuucacgaucaugaccgacggccccagcaacaaggccgccuccuacaagaucuucaagaucgagaaggggaaggugaccaagucgaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugacgguggacggcgcgaacggggucaagggcuucagcuacaaguacgacaacggcguguggaucgggcgcaccaaguccaaccggcugcgcaagggcuucgagaugaucugggaccccaacggguggaccaacaccgacagcgacuucuccgugaagcaggacgucguggccaucacggacuggucgggcuacagcggguccuucgugcagcaccccgagcucaccggccuggacugcauccggcccugcuucugggucgagcuggugcgcggccucccgcgggagaacaccaccaucuggacgucgggguccagcaucuccuucugcggcgucaacagcgacaccgccaacugguccuggcccgacggggccgagcugcccuucaccaucgacaaguga

SEQ ID NO: 25866 - RNA, 1413 nt, Artificial Sequence
  derived and/or modified CDS sequence (AUadapt) from InfluenzaA__AGL96821__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagucgaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugagcguggacggcgcgaacggggucaagggcuucuccuacaaguacgacaacggcguguggaucgggcgcaccaagagcaaccggcugcgcaagggcuucgagaugaucugggaccccaacggguggacgaacaccgacuccgacuucucggugaagcaggacgucguggccaucaccgacuggagcggcuacuccgggagcuucgugcagcaccccgagcucaccggccuggacugcauccggcccugcuucugggucgagcuggugcgcggccucccgcgggagaacacgaccaucuggaccuccgggucguccaucagcuucugcggcgucaacuccgacaccgccaacuggagcuggcccgacggggccgagcugcccuucacgaucgacaaguga

SEQ ID NO: 25867 - RNA, 1410 nt, Artificial Sequence
  derived and/or modified CDS sequence (AUadapt) from InfluenzaA__AGN69269__NA
augaucaccaaccagcgcaucaucaccaucggcacggugugccugaucgucgggaucgugucgcuccugcugcagaucggcaacaucgugucccucuggaucagccacuccauccagaccggggagaagaaccacagcgagaucugcaaccagaacaccaucaccuacgagaacaacacgugggucaaccagaccuacgugaacaucuccaacaccaacaucgccgacggccagggggugaccagcaucauccuggccggcaacuccucgcugugccccaucuccggcugggcgaucuacagcaaggacaacuccauccggaucgggagcaagggcgacaucuucgucauccgcgagccguucaucuccugcagccaccucgagugccggacguucuuccugacccagggggcccugcucaacgaccgccacuccaacggcaccgugaaggaccggagccccuaccgcacccugauguccugccccaucggggaggcccccucgccguacaacucccgguucgagagcguggccuggagcgccuccgcgugccacgacggcaugggcuggaucacgaucgggaucagcggccccgacaacggggccgucgccgugcugaaguacaacggcaucaucaccgacaccaucaaguccuggcgcaacaagauccuccggacccaggagagcgagugcgugugcaucaacggcuccugcuucacgaucaugaccgacgggcccucgaacggccaggccuccuacaagaucuucaagauggagaaggggaagaucaucaagagcgucgagcuggacgcgcccaacuaccacuacgaggagugcuccugcuacccggacaccggcaagguggugugcgucugccgcgacaacuggcacgccagcaaccggcccuggguguccuucgaccagaaccuggacuaccagaucggguacaucugcagcggcguguucggcgacaacccccgcuccaacgacgggaagggcaacugcgggcccgcccucagcaacggcgccaacggggucaagggcuucuccuuccgguacggcaacgggguguggaucggccgcaccaagucgaucuccagccgguccggguucgagaugaucugggacccgaacggcuggacggagaccgacagcagcuucuccaugaagcaggacaucaucgcccugaccgacuggagcggguacuccggcucguucgugcagcaccccgagcugaccggcaugaacugcauccgccccugcuucugggucgagcucauccgggggcagcccaaggaguccacgaucuggaccagcggcuccagcaucuccuucugcgggguggacagcgagaccgcguccuggagcuggccggacggcgccgaccugcccuucaccaucgacaaguga

SEQ ID NO: 25868 - RNA, 1410 nt, Artificial Sequence
  derived and/or modified CDS sequence (AUadapt) from InfluenzaA__AGN69280__NA
augaacaccaaccagcgcaucaucaccaucggcacggugugccugaucgucgggaucgugucgcuccugcugcagaucggcaacaucgugucccucuggaucagccacuccauccagaccggggagaagaaccacagcgagaucugcaaccagaacaccaucaccuacgagaacaacacgugggucaaccagaccuacgugaacaucuccaacaccaacaucgccgacggccagggggugaccagcaucauccuggccggcaacuccucgcugugccccaucuccggcugggcgaucuacagcaaggacaacuccauccggaucgggagcaagggcgacaucuucgucauccgcgagccguucaucuccugcagccaccucgagugccggacguucuuccugacccagggggcccugcucaacgaccgccacuccaacggcaccgugaaggaccggagccccuaccgcacccugauguccugccccaucggggaggcccccucgccguacaacucccgguucgagagcguggccuggagcgccuccgcgugccacgacggcaugggcuggcugacgaucgggaucagcggccccgacaacggggccgucgccgugcucaaguacaacggcaucaucaccgacaccaucaaguccuggcgcaacaagauccugcggacccaggagagcgagugcgugugcaucaacggcuccugcuucacgaucaugaccgacgggcccucgaacggccaggccuccuacaagaucuucaagauggagaaggggaagaucaucaagagcgucgagcuggacgcgcccaacuaccacuacgaggagugcuccugcuacccggacaccggcaagguggugugcgucugccgcgacaacuggcacgccagcaaccggcccuggguguccuucgaccagaaccucgacuaccagaucggguacaucugcagcggcguguucggcgacaacccccgcuccaacgacgggaagggcaacugcgggcccguccugucgaacggcgccaacggggugaagggcuucuccuuccgguacggcaacgggguguggaucggccgcaccaagagcaucuccagccgguccggguucgagaugaucugggacccgaacggcuggacggagaccgacagcagcuucuccaugaagcaggacaucaucgcccugaccgacuggucgggguacuccggcagcuucguccagcaccccgagcucaccggcaugaacugcauccgccccugcuucuggguggagcugauccgggggcagcccaaggaguccacgaucuggaccggcgggagcuccaucagcuucugcggcguggacuccgagaccgccagcugguccuggccggacggcgcggaccugcccuucaccaucgacaaguga

SEQ ID NO: 25869 - RNA, 1410 nt, Artificial Sequence
  derived and/or modified CDS sequence (AUadapt) from InfluenzaA__AGN69292__NA
augaaccccaaccagaagaucaucaccaucggcucgaucugcaugaccaucgggaucgccucccugauccuccagaucggcaacaucaucagcaucuggaucucccacagcauccagacggagaaccagaaccagccggagaucugcaaccagaacgugaucaccuacgagaacaacaccugggucaaccagaccuacgugaacaucuccaacacgaacuucguggccgagcaggcggucgccagcgugaagcuggccgggaacuccucgcugugccccguguccggcugggccaucuacagcaaggacaacuccguccgcaucgggagcaagggcgacguguucgugauccgggagcccuucaucuccugcagccaccucgagugccgcaccuucuuccugacccagggcgcccugcucaacgacaagcacuccaacgggaccaucaaggaccggagccccuaccgcacgcugauguccugcccgaucggcgagguccccucgcccuacaacucccgguucgagagcguggcguggagcgccuccgccugccacgacgggaccagcuggcugaccaucggcaucuccgggcccgacaacggcgccguggcgguccucaaguacaacggcaucaucaccgacacgaucaagucguggcgcaagaacauccugcggacccaggaguccgagugcgccugcgugaacgggagcugcuucaccgugaugaccgacggcccguccaacgggcaggccagcuacaaggucuucaagaucgagaagggcaagguggugaaguccgucgagcugaacgcccccaacuaccacuacgaggagugcagcugcuaccccgaguccggcgagaucacgugcgugugccgcgacaacuggcacgggagcaaccggcccuggguguccuucaaccagaaccucgaguaccagaugggcuacaucugcucggggaucuucggcgacaacccgcgccccaacgacaagaccggguccugcggccccgucuucagcaacggcgccaacggggugaagggcuucuccuucaaguacgggaacggcguguggaucgggcggaccaagagcaucuccagccgcaugggcuucgagaugaucugggaccccgacggcuggaccaagacggacgacaaguucucggucaagcaggacaucaucgggaucaacgacugguccggcuacagcggguccuucgugcagcacccggagcugaccggccuggacugcaugcggcccugcuucugggucgagcucauccgcgggcggcccaaggagaacaccaucuggaccagcggcuccagcaucuccuucugcggcgugaacagcgacacgguggggugguccuggcccgacggcgcggagcugccguucaccaucgacaaguga

SEQ ID NO: 25870 - RNA, 1410 nt, Artificial Sequence
  derived and/or modified CDS sequence (AUadapt) from InfluenzaA__AGN69316__NA
augaaccccaaccagaagaucaucaccaucggcucgaucugcaugaccaucgggaucgccucccugauccuccagaucggcaacaucaucagcaucuggaucucccacagcauccagacggagaaccagaaccagccggagaucugcaaccagaacgugaucaccuacgagaacaacaccugggucaaccagaccuacgugaacaucuccaacacgaacuucguggccgagcaggcggucgccucggugaagcuggccgggaacuccagccugugccccguguccggcugggccaucuacagcaaggacaacuccguccgcaucgggagcaagggcgacguguucgugauccgggagcccuucaucuccugcucgcaccucgagugccgcaccuucuuccugacccagggcgcccugcucaacgacaagcacuccaacgggaccaucaaggaccggagccccuaccgcacgcugauguccugcccgaucggcgagguccccagccccuacaacucccgguucgagagcguggcguggucggccuccgccugccacgacgggaccagcuggcugaccaucggcaucuccgggcccgacaacggcgccguggcgguccucaaguacaacggcaucaucaccgacacgaucaagagcuggcgcaagaacauccugcggacccaggaguccgagugcgccugcgugaacgggagcugcuucaccgugaugaccgacggcccguccaacgggcaggccucguacaaggucuucaagaucgagaagggcaagguggugaagacggucgagcugaacgcccccaacuaccacuacgaggagugcuccugcuaccccgagagcggcgagaucacgugcgugugccgcgacaacuggcacggguccaaccggcccugggugagcuucaaccagaaccucgaguaccagaugggcuacaucugcuccgggaucuucggcgacaacccgcgccccaacgacaagaccgggagcugcggccccgucuucuccaacggcgccaacggggugaagggcuucucguucaaguacgggaacggcguguggaucgggcggaccaaguccaucagcucccgcaugggcuucgagaugaucugggaccccgacggcuggaccaagaccgacgacaaguucagcgucaagcaggacaucaucgggaucaacgacuggagcggcuacuccgggucguucgugcagcacccggagcugaccggccuggacugcaugcggcccugcuucugggucgagcucauccgcgggcggcccaaggagaacaccaucuggacguccggcagcuccaucagcuucugcggcgugaacuccgacaccgugggguggagcuggcccgacggcgcggagcugccguucaccaucgacaaguga

SEQ ID NO: 25871 - RNA, 1410 nt, Artificial Sequence; identical to SEQ ID NO: 25870
  derived and/or modified CDS sequence (AUadapt) from InfluenzaA__AGN69328__NA

SEQ ID NO: 25872 - RNA, 1410 nt, Artificial Sequence
  derived and/or modified CDS sequence (AUadapt) from InfluenzaA__AGN69340__NA
augaaccccaaccagaagaucaucaccaucggccugaucugcaugaccaucgggaucgccucgcucauccugcagaucggcaacaucaucuccaucuggaucagccacuccauccagacggagaaccagaacaagccggagaucugcaaccagaacgugaucaccuacgagaacaacaccugggucaaccagaccuacgugaacgugagcaacacgaacuucgucgccgagcaggcgguggccuccgugaagcuggucgggaacagcucccucugccccgugagcggcugggccaucuacuccaaggacaacucggugcgcaucggguccaagggcgacgucuucgugauccgggagcccuucaucagcugcucccaccuggagugccgcaccuucuuccugacccagggcgcccuccugaacgacaagcacagcaacgggaccaucaaggaccggucccccuaccgcacgcugaugagcugcccgaucggcgaggugcccucccccuacaacagccgguucgaguccgucgccuggucggcgagcgccugccacgacgggaccuccuggcucaccaucggcaucagcgggcccgacaacggcgccguggccgugcugaaguacaacggcaucaucaccgacacgaucaaguccuggcgcaagaacauccugcggacccaggagagcgagugcgcgugcgucaacggguccugcuucaccgugaugaccgacggcccgagcaacgggcaggccuccuacaagguguucaagaucgagcgcggcaaggucgucaagagcguggagcucaacgcccccaacuaccacuacgaggagugcuccugcuaccccgagucguccgagaucacgugcgugugccgggacaacuggcacggcagcaaccgccccuggguguccuucaaccagaaccuggaguaccagaugggguacaucugcagcggcguguucggggacaacccgcggcccaacgacaagaccggcuccugcgggcccgucuucagcaacggcgccaacggcgugaagggguucuccuucaaguacggcaacggggucuggaucggccgcaccaagagcaccuccucgcggaugggguucgagaugaucugggaccccgacggcuggacgaagaccgacgacaaguucagcgugaagcaggacaucaucggcaucaccgacugguccggguacagcggcuccuucgugcagcacccggagcugaccgggcucgacugcaugcgccccugcuucugggucgagcugauccggggccgccccaaggagaacacgaucuggaccagcggguccagcaucuccuucugcggcgugaacagcgacaccgugggcugguccuggcccgacggggccgagcugccguucaccaucgacaaguga

SEQ ID NO: 25873 - RNA, 1410 nt, Artificial Sequence
  derived and/or modified CDS sequence (AUadapt) from InfluenzaA__AGO00268__NA
augaaccccaaccagaagaucaucaccaucggcucgaucugcaugguggucgggaucaucucccugauccuccagaucggcaacaucaucagcaucuggaucucccacagcauccagaccgggucccagaaccacacgggcaucugcaaccagagcaucaucaccuacaagaacuccaccugggugaaccagaccuacgugaacaucucgaacacgaacgucguggccgggaaggacaccaccuccaugauccuggccggcaacagcucccugugcccgauccgcggcugggcgaucuacagcaaggacaacgggauccggaucggcuccaagggggacguguucgucauccgcgagcccuucaucagcugcucccaccucgagugccggaccuucuuccugacgcagggcgcccugcucaacgacaagcacagcaacgggaccgugaaggaccgcucccccuaccgggcccugaugucgugccccgugggcgaggccccgucccccuacaacagccgcuucgagagcgucgccugguccgcgagcgccugccacgacggcaugggguggcugaccaucggcaucuccgggcccgacgacggcgccguggccgugcucaaguacaacggcaucaucaccgagacgaucaagucguggaagaagaagauccugcggacccaggaguccgagugcgucugcgugaacgggagcugcuucaccaucaugaccgacggccccuccgacgggccggcgagcuacaagaucuucaagaucgagaagggcaaggugacgaaguccaucgagcuggacgcccccaacagccacuacgaggagugcuccugcuaccccgacaccgggaaggucaugugcgugugccgcgacaacuggcacggcagcaaccggcccuggguguccuucgaccagaaccucgacuaccagaucggcuacaucugcucgggggucuucggcgacaacccgcgccccaaggacgggaagggcuccugcgggcccguguacguggacggcgccaacggcgucaagggguucagcuaccgguacggcgacgggguguggaucggccgcaccaaguccaacagcucccggcagggguucgagaugaucugggaccccaacggcuggaccgagacggacagcucguucuucgugaagcaggacgucguggccaugaccgacugguccggcuacagcggguccuucguccagcacccggagcugaccggccugaacugcaugcgccccugcuucuggguggagcucauccgggggcgccccaaggagaagaccaucuggacgagcggcuccagcaucuccuucugcggcgugaacagcgacaccgucgacugguccuggcccgacggggccgagcugccguucaccaucgacaaguga

SEQ ID NO: 25874 - RNA, 1410 nt, Artificial Sequence
  derived and/or modified CDS sequence (AUadapt) from InfluenzaA__AGO00280__NA
augaaccccaaccagaagaucaucaccaucggcucgaucugcaugguggucgggaucaucucccugauccuccagaucggcaacaucgugagcaucuggaucucccacagcauccagaccgggaaccagaaccacacggggaccugcaaccaguccaucaucaccuacaagaacucgaccugggugaaccagacguacgucaacaucuccaacaccaacgugguggccggcaaggacaccaccagcgucauccuggccggcaacuccagccugugcccgauccgcggcugggcgaucuacuccaaggacaacggggugcggaucggcucgaagggggacguguucgucauccgcgagcccuucaucuccugcagccaccucgagugccggacguucuuccugacccagggcgcccugcucaacgacaagcacuccaacgggaccgugaaggaccgcagccccuaccgggcccugauguccugccccgugggcgaggccccgagccccuacaacucccgcuucgagucggucgccuggagcgcguccgccugccacgacggcaugggguggcugaccaucggcaucagcgggcccgacgacggcgccguggccgugcucaaguacaacggcaucaucacggagaccaucaaguccuggcggaaggagauccugcgcacccaggagucggagugcgucugcgugaacggguccugcuucaccaucaugacggacggccccagcgggggcccggcguccuacaagaucuucaagaucgagaaggggaaggugaccaagagcaucgagcuggacgcccccaacucccacuacgaggagugcucgugcuaccccgacaccuccaaggucaugugcgugugccgggacaacuggcacggcagcaaccgccccuggguguccuucgaccagaaccucgacuaccagaugggcuacaucugcagcggggucuucggcgacaacccgcggcccaaggacgggaagggcuccugcgggcccguguacguggacggcgccaacggcgucaagggguucagcuaccgcuacggcaacgggguguggaucggccggaccaaguccaacucgucccgccagggguucgagaugaucugggaccccaacggcuggacggagaccgacagcaacuucuucaugaagcaggacgucguggccgugaccgacuggagcggcuacuccgggucguucguccagcacccggagcugaccggccuggacugcaugcggcccugcuucuggguggagcucauccgcgggcggcccaaggagaacacgaucuggaccuccggcagcuccaucagcuucugcggcgugaacuccgacaccgucgacuggagcuggcccgacggggccgagcugccguucaccaucgacaaguga

SEQ ID NO: 25875 - RNA, 1413 nt, Artificial Sequence
  derived and/or modified CDS sequence (AUadapt) from InfluenzaA__AGO00292__NA
augaaccccaaccagaagaucaucaccaucggcucgaucugcaugaccaucgggacgaucucccugauccuccagaucggcaacaucaucagcaucuggaucucccacucgauccagaccgggucccagaaccacaccggcaucugcaaccagcgcaucaucaccuacgagaacaacacgugggugaaccagaccuacgucaacaucagcaacaccaacgugguggccgggaaggacaccacguccaugauccuggccggcaacagcucccugugcccgauccggggcugggcgaucuacucgaaggacaacuccauccgcaucgggagcaagggcgacgucuucgugauccgggagcccuucaucuccugcucgcaccucgagugccgcaccuucuuccugacccagggggcccugcucaacgacaagcacuccaacggcaccgugaaggaccggagccccuaccgcgcccugauguccugccccaucggggaggccccgagccccuacaacucccgguucgagucggucgccuggagcgcguccgccugccacgacggcaugggcuggcugacgaucgggaucagcggccccgacgacggggccguggccgugcucaaguacaacggcaucaucaccgagaucaucaaguccuggcgcaagcagauccugcggacccaggagucggagugcgucugcgugaacggcuccugcuucaccaucaugacggacgggcccagcgacggcccggcguccuaccgcaucuucaagaucgagaaggggaagaucaccaagucgaucgagcuggacgcccccaacucccacuacgaggagugcagcugcuaccccgacaccggcaaggugaugugcgucugccgggacaacuggcacggguccaaccgccccugggugagcuucaaccagaaccucgacuaccagaucggcuacaucugcuccggcguguucggggacaacccgcggcccaaggacggcaaggggucgugcgaccccgucaacguggacggcgccgacggggugaagggcuucuccuaccgcuacggcgacggggucuggaucggccggaccaagagcaacuccucgcgcaagggguucgagaugaucugggaccccaacggcuggacggacaccgacgacaacuuccuggugaagcaggacguggucgccaugaccgacugguccggguacagcggcagcuucgugcagcacccggagcugaccggccucgacugcauccggcccugcuucuggguggagcugauccgcgggcggccccgcgagaagacgaccaucuggaccuccggcucguccaucagcuucugcggggucaacuccgacaccgugaacuggagcuggcccgacggcgccgagcugccguucacgaucgacauguga

SEQ ID NO: 25876 - RNA, 1413 nt, Artificial Sequence
  derived and/or modified CDS sequence (AUadapt) from InfluenzaA__AGO00304__NA
augaaccccaaccagaagaucaucaccaucggcucgaucugcauggccaucgggaccaucucccugauccuccagaucggcaacaucaucagcaucuggaucucccacucgauccagacggggucccagaaccacaccggcaucugcaaccagcgcaucaucaccuacgagaacaacaccugggugaaccagacguacgucaacaucagcaacaccaacgugguggccgggaaggacaccaccuccaugauccuggcgggcaacacgucgcugugcccgauccggggcugggccaucuacuccaaggacaacagcauccgcaucggguccaagggcgacgucuucgugauccgggagcccuucaucucgugcucccaccucgagugccgcaccuucuuccugacccagggggcccugcucaacgacaagcacagcaacggcaccgugaaggaccggucccccuaccgcgcccugaugucgugccccaucggggaggccccgucccccuacaacagccgguucgaguccgucgcguggucggccagcgccugccacgacggcaugggcuggcugacgaucgggaucuccggccccgacgacggggccguggcggugcucaaguacaacggcaucaucaccgagaucaucaagagcuggcgcaagcagauccugcggacccaggaguccgagugcgucugcgugaacggcucgugcuucaccaucaugacggacgggcccuccaacggcccggccagcuaccgcaucuucaagaucgagaaggggaagaucaccaaguccaucgagcuggacgcccccaacucgcacuacgaggagugcuccugcuaccccgacaccggcaaggugaugugcgucugccgggacaacuggcacgggagcaaccgccccuggguguccuucaaccagaaccucgacuaccagaucggcuacaucugcucgggcguguucggggacaacccgcggcccaaggacggcaagggguccugcgaccccgucaacguggacggcgccgacggggugaagggcuucagcuaccgcuacggcaacggggucuggaucggccggaccaaguccaacucgucccgcaagggguucgagaugaucugggaccccaacggcuggacgaacaccgacgggaacuucagcgugaagcaggacguggucgccaugaccgacugguccggcuacucgggcagcuucgugcagcacccggagcugaccgggcuggacugcaugcggcccugcuucuggguggagcucauccgcggccggccccgcgagaagacgaccaucuggaccuccgggucguccaucagcuucugcggcgucaacuccgacaccgugaacuggagcuggcccgacggcgcggagcugccguucacgaucgacaaguga

SEQ ID NO: 25877 - RNA, 1410 nt, Artificial Sequence; identical to SEQ ID NO: 24946
  derived and/or modified CDS sequence (AUadapt) from InfluenzaA__AGO00316__NA

SEQ ID NO: 25878 - RNA, 1410 nt, Artificial Sequence; identical to SEQ ID NO: 24390
  derived and/or modified CDS sequence (AUadapt) from InfluenzaA__AGO00328__NA

SEQ ID NO: 25879 - RNA, 1410 nt, Artificial Sequence; identical to SEQ ID NO: 16337
  derived and/or modified CDS sequence (AUadapt) from InfluenzaA__AGO00340__NA

SEQ ID NO: 25880 - RNA, 1365 nt, Artificial Sequence; identical to SEQ ID NO: 16322
  derived and/or modified CDS sequence (AUadapt) from InfluenzaA__AGO00352__NA

SEQ ID NO: 25881 - RNA, 1365 nt, Artificial Sequence; identical to SEQ ID NO: 16322
  derived and/or modified CDS sequence (AUadapt) from InfluenzaA__AGO00376__NA

SEQ ID NO: 25882 - RNA, 1365 nt, Artificial Sequence; identical to SEQ ID NO: 16322
  derived and/or modified CDS sequence (AUadapt) from InfluenzaA__AGO00388__NA

SEQ ID NO: 25883 - RNA, 1365 nt, Artificial Sequence; identical to SEQ ID NO: 16322
  derived and/or modified CDS sequence (AUadapt) from InfluenzaA__AGO00400__NA

SEQ ID NO: 25884 - RNA, 1365 nt, Artificial Sequence; identical to SEQ ID NO: 16322
  derived and/or modified CDS sequence (AUadapt) from InfluenzaA__AGO00412__NA

SEQ ID NO: 25885 - RNA, 1365 nt, Artificial Sequence; identical to SEQ ID NO: 16322
  derived and/or modified CDS sequence (AUadapt) from InfluenzaA__AGO00424__NA

SEQ ID NO: 25886 - RNA, 1365 nt, Artificial Sequence
  derived and/or modified CDS sequence (AUadapt) from InfluenzaA__AGO00436__NA
augaaucccaaccagaagaucaucaccaucggcucgaucugccugguggucgggcucaucucccugauccugcagaucggcaacaucaucagcaucuggaucucccacagcauccagaccgggucccagaaccacacgggcaucugcaaccagaacaucaucaccuacaagaacagcaccugggugaaggacaccacguccgugauccucaccgggaacucgucccugugcccgauccgcggcugggccaucuacagcaaggauaacuccauccggaucggcagcaagggggacgucuucgugauccgcgagcccuucaucuccugcagccaccuggagugccggaccuucuuccucacccagggcgcccugcugaacgacaagcacuccucggggacggugaaggaccgcucccccuaccgggcgcucaugagcugccccgucggcgaggccccgucccccuacaacagccgcuuugagagcguggccugguccgccucggccugccacgacgggaugggcuggcugaccaucggcaucuccgggcccgacaacggcgcgguggccguccugaaguacaacgggaucaucaccgagaccaucaagagcuggcggaagaagauccuccgcacgcaggaguccgagugcgccugcgugaacggcagcugcuucaccaucaugaccgacggccccuccgacgggcuggccagcuacaagaucuucaagaucgagaagggcaaggugaccaaguccaucgagcugaacgcgccgaauucgaacuacgaggagugcuccugcuaccccgacacggggaaggucaugugcgugugccgggacaacuggcacggcagcaaccgccccuggguguccuucgaccagaaccucgacuaccagaucggguacaucugcaguggcgucuucggcgacaacccccggccggaggacgggaccggcuccugcgggcccguguacguggacggcgccaacggggucaagggcuucagcuaccgcuacggcaacgggguguggaucggccggaccaagucccacucgucccgccacggguucgagaugaucugggaccccaacggcuggaccgagacggacagcaaguucagugugcggcaggacgucguggccaugaccgacugguccggguacagcggcuccuucgugcagcaccccgagcugaccggccuggacugcaugcgcccgugcuucugggucgagcucauccgggggcgccccaaggagaagaccaucuggacgucggccuccagcaucuccuucugcggcgugaacagcgacaccgucgacugguccuggcccgacggggccgagcugcccuucagcaucgacaaguga

SEQ ID NO: 25887 - RNA, 1365 nt, Artificial Sequence
  derived and/or modified CDS sequence (AUadapt) from InfluenzaA__AGO00448__NA
augaaucccaaccagaagaucaucaccaucggcucgaucugccugguggucgggcucaucucccugauccugcagaucggcaacaucaucagcaucuggaucucccacagcauccagaccgggucccagaaccacacgggcaucugcaaccagaacaucaucaccuacaagaacaguaccugggugaaggacaccacguccgugauccucaccgggaacagcucccugugcccgauccgcggcugggccaucuacagcaaggacaacuccauccggaucggcagcaagggggacgucuucgugauccgcgagcccuucaucuccugcucgcaucuggagugccggaccuucuuccucacccagggcgcccugcugaacgacaagcacuccagcgggacggugaaggaccgcucccccuaccgggcgcucaugagcugccccgucggcgaggccccgucccccuacaacagccgcuuugagagcguggccugguccgccagcgccugccacgacgggaugggcuggcugaccaucggcaucuccgggcccgacaacggcgcgguggccguccugaaguacaacgggaucaucaccgagaccaucaagagcuggcggaagaagauccuccgcacgcaggaguccgagugcgccugcgugaacggcucguguuucaccaucaugaccgacggccccuccgacgggcuggccagcuaccggaucuucaagaucgagaagggcaaggugaccaaguccaucgagcugaacgcgccgaacagccacuacgaggagugcuccugcuaccccgauacggggaaggucaugugcgugugccgcgacaacuggcacggcagcaaccggcccuggguguccuucgaccagaaccucgacuaccagaucggguacaucugcaguggcgucuucggcgacaacccccgcccggaggacgggaccggcuccugcgggcccguguacguggacggcgccaacggggucaagggcuucagcuaccgguacggcaacgggguguggaucggccgcaccaagucccacaguucccggcacggguucgagaugaucugggaccccaacggcuggaccgagacggacucgaaguucagcgugcgccaggacgucguggccaugaccgacugguccggguacagcggcuccuucgugcagcaccccgagcugaccggccuggauugcaugcggccgugcuucugggucgagcucauccgcgggcggcccaaggagaagaccaucuggacgagcgccuccagcaucuccuucugcggcgugaacagcgacaccgucgacugguccuggcccgacggggccgagcugcccuucagcaucgacaaguga

SEQ ID NO: 25888 - RNA, 1410 nt, Artificial Sequence
  derived and/or modified CDS sequence (AUadapt) from InfluenzaA__AGQ47722__NA
augaacaccaaccagcgcaucaucaccaucggcacgaucugccugaucguggggaucaucucgcuccugcugcagaucggcaacaucaucucccucuggaucagccacuccauccagaccggggagaagucccaccccgagaucugcaaccagagcgucaucaccuacgagaacaacaccugggugaaccagacguacgugaacaucagcaacaccaacaucgccgccggccagggggucaccccgaucauccuggcgggcaacuccagccugugccccaucuccggcugggccaucuacucgaaggacaacuccauccggaucgggagcaagggcgacaucuucgugaugcgcgagcccuucaucuccugcagccaccucgagugccggaccuucuuccugacgcagggggcccugcucaacgaccgccacuccaacggcaccgugaaggaccggagccccuaccgcacccugauguccugcccgaucggggaggcccccagccccuacaacucccgguucgagagcgucgccuggucggcguccgccugccacgacggcaugggcuggcugaccaucgggaucagcggccccgacaacggggccguggccgugcucaaguacaacggcaucaucacggacaccaucaaguccuggcgcaacaagauccugcggacccaggagagcgagugcgucugcaucaacggcuccugcuucaccaucaugacggacgggccgagcaacggccaggcguccuacaagaucuucaagauggagaaggggaagaucaucaagagcaucgagcuggacgcccccaacuaccacuacgaggagugcuccugcuaccccgacaccggcaaggugaugugcgugugccgcgacaacuggcacgccagcaaccggcccugggucuccuucgaccagaaccucgacuaccagaucggguacaucugcucgggcguguucggcgacaacccgcgcuccaacgacgggaagggcaacugcgggcccgugcugagcaacggcgccaacggggucaagggcuucuccuuccgguacggcaacgggguguggaucggccgcaccaagagcaucuccagccgguccggguucgagauggugugggaccccaacggcuggaccgagacggacagcagcuucuccaugaagcaggacaucaucgcccugaccgacuggucgggguacuccggcagcuucguccagcaccccgagcucaccggcaugaacugcauccgcccgugcuucuggguggagcugauccgggggcagcccaaggaguccaccaucuggacgagcggcuccagcaucuccuucugcggggugaacagcggcaccgcguccuggagcuggcccgacggcgccgaccugcccuucaccaucgacaaguga

SEQ ID NO: 25889 - RNA, 1413 nt, Artificial Sequence; identical to SEQ ID NO: 18855
  derived and/or modified CDS sequence (AUadapt) from InfluenzaA__AGQ47731__NA

SEQ ID NO: 25890 - RNA, 1377 nt, Artificial Sequence
  derived and/or modified CDS sequence (AUadapt) from InfluenzaA__AGQ47743__NA
augaaucccaaccagaagaucaucaccaucggcucgaucugcaugguggucgggaucaucucccugauccuccagaucggcaacaucaucucgaucuggaucucccacagcauccagaccgggaaccagaaccacaagaacuccacguggaugaaccagaccuacaucaacaucucgaacaccaacgugguggccggccaggacuccaccagcgucauccugacggggaacuccucgcugugcccgauccgcggcugggccaucaacuccaaggacaacggcauccggaucgggagcaagggcgacguguucgugauccgcgagcccuucaucuccugcucgcaccucgagugccggaccuucuuccugacccagggggcgcugcucaacgacaagcacuccaacggcaccgucaaggaccgcagccccuaccgggcccugauguccugccccgugggggaggccccgucgcccuacaacucccgcuucgagucgguggccuggagcgccuccgcgugccacgacggcaugggcuggcugacgaucgggaucucgggccccgacaacggggccgucgccgugcucaaguacaacggcaucaucaccgagaccaucaaguccuggcggaagaagauccugcgcacccaggagagcgagugcacgugcgugaacggcuccugcuucaccaucaugaccgacgggcccucgaacggccuggccuccuacaagaucuuuaagaucgagaaggggaaggucaccaagagcaucgagcucaacgcgccgaacucccacuacgaggagugcucgugcuaccccgacacgggcaaggugaugugcgugugccgggacaacuggcacggguccaaccgccccugggucagcuucgaccagaaccuggacuaccagaucggcuacaucugcuccggcguguucggggacaacccccggccgaaggacggcaccgggucgugcggccccguguccgccgacggggccaacggcgucaagggcuucucguaccgcuacgggaacggcguguggaucgggcggaccaaguccaacagcucccgccacggcuucgagaugaucugggaccccaacggguggaccgagacggacucgcgguucagcgugcgccaggacgucguggccaugaccgaccgguccggcuacucgggcuccuucgugcagcaccccgagcugaccgggcucgacugcaugcgcccgugcuucugggucgagcugauccggggccgccccgaggaggagaccaucuggacgagcggguccaucaucucguucugcggcgugaacuccgacaccgucgacuggagcuggcccgacggcgccgagcugcccuucaccaucgacaaguga

SEQ ID NO: 25891 - RNA, 1413 nt, Artificial Sequence
  derived and/or modified CDS sequence (AUadapt) from InfluenzaA__AGQ47755__NA
augaaccccaaccagaagaucaucaccaucggcucgaucugcauggccaucgggaccaucucccugauccuccagaucggcaacaucaucagcaucuggaucucccacucgauccagacggggucccagaaccacaccggcaucugcaaccgccggaucgugaccuacgagaacaacaccugggucaaccagacguacgugaacaucagcaacaccaacguggucgccgagaaggacaccaccuccaugauccuggcggggaacucgucccugugcccgauccgcggcugggccaucuacagcaaggacaacuccauccggaucggcagcaagggggacguguucgugauccgcgagcccuucaucuccugcucgcaccucgagugccggacguucuuccugacccagggcgcccugcucaacgacaagcacuccaacgggaccgucaaggaccgcagccccuaccgggcccugauguccugccccaucggcgaggccccgucgcccuacaacucccgcuucgagagcguggcguggucggccuccgccugccacgacgggaugggcuggcugaccaucggcaucagcgggcccgacgacggcgccguggcgguccucaaguacaacgggaucaucacggagaucaucaaguccuggcggaagcagauccugcgcacccaggagagcgagugcgugugcgugaacggcuccugcuucaccaucaugaccgacggccccucgaacgggccggccuccuaccggaucuucaagaucaagaagggcaagaucaccaagagcaucgagcuggacgcccccaacucccacuacgaggagugcucgugcuaccccgacacggggaaggucaugugcgugugccgcgacaacuggcacggcuccaaccggcccugggugagcuucaaccagaaccucgacuaccagaucggguacaucugcuccggcgucuucggcgacaacccgcgccccaaggacgggaagggcucgugcgaccccgugaacguggacggggccgacggcgucaagggguucuccuaccgguacggcaacggcguguggaucgggcgcaccaagagcaccuccagccggaagggcuucgagaugaucugggaccccaacggguggacggacaccgacggcaacuuccuggugaagcaggacgucguggccaugaccgacugguccggguacucgggcagcuucgugcagcacccggagcugaccggccucgacugcaugcgccccugcuucugggucgagcugauccgggggcgcccccgggagaagacgaccaucuggaccuccggcucguccaucagcuucugcggggugaacuccgacaccgucaacuggagcuggcccgacggcgcggagcugccguucacgaucgacaaguga

SEQ ID NO: 25892 - RNA, 1410 nt, Artificial Sequence
  derived and/or modified CDS sequence (AUadapt) from InfluenzaA__AGQ47767__NA
augaaccccaaccagaagaucaucaccaucggcucgaucugcaugguggucgggaucaucucccugauccuccagaucggcaacaucgugagcaucuggaucucccacagcauccagaccgggaaccagaaccacacggggaccugcgaccaguccaucaucaccuacaagaacucgaccugggugaaccagacguacgucaacaucuccaacaccaacgugguggccggcaaggacaccaccagcgucauccuggccggcaacuccagccugugcccgauccgcggcugggcgaucuacuccaaggacaacggggugcggaucggcucgaagggggacguguucgucauccgcgagcccuucaucuccugcagccaccucgagugccggacguucuuccugacccagggcgcccugcucaacgacaagcacuccaacgggaccgugaaggaccgcagccccuaccgggcccugauguccugccccgugggcgaggccccgucgcccuacaacucccgcuucgagagcgucgccuggagcgcguccgccugccacgacggcaugggguggcugaccaucggcaucucggggcccgacgacggcgccguggccgugcucaaguacaacggcaucaucacggagaccaucaaguccuggcggaaggagauccugcgcacccaggagagcgagugcgucugcgugaacggguccugcuucaccaucaugacggacggccccagcgggggcccggcguccuacaagaucuucaagaucgagaaggggaaggugaccaagucgaucgagcuggacgcccccaacucccacuacgaggagugcagcugcuaccccgacaccuccaaggucaugugcgugugccgggacaacuggcacggcagcaaccgccccuggguguccuucgaccagaaccucgacuaccagaugggcuacaucugcucgggggucuucggcgacaacccgcggcccaaggacgggaagggcuccugcgggcccguguacguggacggcgccaacggcgucaagggguucagcuacaaguacggcaacgggguguggaucggccgcaccaaguccaacagcucccggcagggguucgagaugaucugggaccccaacggcuggacggagaccgacucgaacuucuucaccaagcaggacgucguggccgugaccgacuggagcggcuacuccgggagcuucguccagcacccggagcugacgggccuggacugcaugcgccccugcuucuggguggagcucauccgggggcgccccaaggagaacaccaucuggaccuccggcucguccaucagcuucugcggcgugaacuccgacaccgucgacuggagcuggcccgacggggccgagcugccguucacgaucgacaaguga

SEQ ID NO: 25893 - RNA, 1410 nt, Artificial Sequence; identical to SEQ ID NO: 25874
  derived and/or modified CDS sequence (AUadapt) from InfluenzaA__AGQ47779__NA

SEQ ID NO: 25894 - RNA, 1413 nt, Artificial Sequence
  derived and/or modified CDS sequence (AUadapt) from InfluenzaA__AGQ47791__NA
augaaccccaaccagaagaucaucaccaucggcucgaucugcauggccaucgggaucaucucccugauccuccagaucggcaacaucaucagcaucugggugucccacucgauccagaccgggucccagaaccacacgggcaucugcaaccagcgcaucaucaccuacgagaacaacaccugggucaaccagacccacgugaacaucagcaacacgaacguggucgccgggaaggacaccaccuccaugauccuggcgggcaacucgucccugugcccgauccggggcugggccaucuacagcaaggacaacuccauccgcaucgggucgaagggcgacguguucgugauccgggagcccuucaucuccugcagccaccucgagugccgcaccuucuuccugacgcagggggcccugcucaacgacaagcacuccaacggcaccgucaaggaccggucgcccuaccgcgcccugauguccugccccaucggggaggccccgagccccuacaacucccgguucgagucgguggcguggagcgccuccgccugccacgacggcaugggcuggcugaccaucgggaucagcggccccgacgacggggccguggcgguccucaaguacaacggcaucaucaccgagacgaucaaguccuggaagaagcagauccugcgcacccaggagucggagugcgugugcgugaacggcuccugcuucaccaucaugaccgacgggcccagcgacggcccggccuccuaccggaucuucaagaucgagaaggggaagaucaccaagucgaucgagcuggacgcccccaacucccacuacgaggagugcagcugcuaccccgacacgggcaccgucaugugcgugugccgcgacaacuggcacggguccaaccggcccugggugucguucaaccagaaccucgacuaccagaucggcuacaucugcuccggcgucuucggggacaacccgcgccccaaggacggcaaggggagcugcgaccccgugaacguggacggcgccgacggggucaagggcuucuccuaccgguacggcaacgggguguggaucggccgcaccaagucgaacuccagccggaagggguucgagaugaucugggaccccaacggcuggacggacaccgacgggaacuuccuggugaagcaggacgucguggccaugaccgacugguccggcuacucgggcagcuucgugcagcacccggagcugaccgggcucgacugcaugcgccccugcuucugggucgagcugauccggggccgcccccgggagaagacgaccaucuggaccuccgggucguccaucagcuucugcggcgugaacuccgacaccgucaacuggagcuggcccgacggcgcggagcugccguucacgaucgacaaguga

SEQ ID NO: 25895 - RNA, 1410 nt, Artificial Sequence
  derived and/or modified CDS sequence (AUadapt) from InfluenzaA__AGQ47803__NA
augaaccccaaccagaagaucaucaccaucggcucgaucugcaugguggucgggaucaucucccugauccuccagaucggcaacaucaucagcaucuggaucucccacagcauccagaccgggucccagaaccacacgggcaucugcaaccagagcaucaucaccuacaagaacuccaccugggugaaccagaccuacgugaacaucucgaacacgaacgucguggccgggaagggcaccaccuccgugauccuggccggcaacagcucccugugcccgauccgcgggugggcgaucuacagcaaggacaacggcauccggaucggguccaagggcgacgucuucgugauccgcgagcccuucaucagcugcucccaccucgagugccggaccuucuuccugacgcagggggcccugcucaacgacaagcacucgaacggcaccgugaaggaccgcucccccuaccgggcccugaugagcugccccgucggcgaggccccgucccccuacaacagccgcuucgagagcguggccugguccgcgugcgccugccacgacgggaugggcuggcugaccaucgggaucagcggccccgacgacgaggccguggccguccucaaguacaacggcaucaucaccgagacgaucaaguccuggcggaagaagauccugcgcacccaggagucggagugcgugugcgugaacggguccugcuucaccaucaugaccgacggccccagcgacgggccggcguccuacaagaucuucaagaucgagaagggcaaggucaccaagagcaucgagcuggacgcccccaacucccacuacgaggagugcagcugcuaccccgacacggggaaggugaugugcgugugccgggacaacuggcacggcuccaaccgccccugggucucguucgaccagaaccucgacuaccagaucggcuacaucugcuccgggguguucggcgacaacccgcggcccaaggacgggaagggcagcugcgggcccguguacgucgacggcgccaacggcgugaagggguucuccuaccgcuacggcaacgggguguggaucggccggaccaagagcgacuccagccgccagggguucgagaugaucugggaccccaacggcuggaccgagacggacuccaacuucuucgucaagcaggacaucguggccaugaccgacuggucgggcuacagcggguccuucguccagcacccggagcugaccggccuggacugcaugcggcccugcuucuggguggagcucauccgcgggcggcccaaggagaagaccaucuggacgagcggcuccagcaucuccuucugcggcgugaacagcgacaccgucgacugguccuggcccgacggggccgagcugccguucaccaucgacaaguga

SEQ ID NO: 25896 - RNA, 1368 nt, Artificial Sequence
  derived and/or modified CDS sequence (AUadapt) from InfluenzaA__AGQ47814__NA
augaaucccaaccagaagaucaucaccaucggcucgaucugcauggccaucgggaucaucucccugauccuccagaucggcaacaucaucucgaucugggugucccacagcauccagaccgggucccagaaccacacgggcaucugcaaccagcgcaucaucaccuacgagaacaacaccugggucaaggacaccacgucgaugacccuggccgggaacuccagccugugcccgauccggggcugggcgaucuacuccaaggacaacucgauccgcaucggcuccaagggggacguguucgugauccgggagcccuucaucagcugcucccaccucgagugccgcaccuucuuccugacccagggcgcccugcucaacgauaagcacucgaacgggacggucaaggaccggucccccuaccgcgcccugaugagcugccccaucggcgaggccccgucccccuacaacucgcgguucgaguccguggccuggagcgcgucggccugccacgacgggaugggcuggcugaccaucggcaucuccgggcccgacgacggcgccguggccguccucaaguacaacgggaucaucaccgagaccaucaagagcuggaagaagcagauccugcgcacgcaggaguccgagugcgugugcgugaacggcucgugcuucaccaucaugaccgacggccccuccgacgggccggcgagcuaccggaucuucaagaucgagaagggcaagaucaccaaguccaucgagcuggacgcccccaauucgcacuacgaggagugcuccugcuaccccgacacggggaccgucaugugcgugugccgcgacaacuggcacggcagcaaccggcccuggguguccuucaaccagaaccucgacuaccagaucggguacaucugcucgggcgucuucggcgacaacccgcgccccaaggacgggaagggcuccugcgaccccgugaacguggacggggccgacggcgucaagggguucagcuaucgguacggcaacggcguguggaucgggcgcaccaaguccaacucgucccggaagggcuucgagaugaucugggaccccaacggguggaccgacacggacggcaacuuccuggugaagcaggacgucguggccaugaccgacuggagcggguacuccggcucguucgugcagcacccggagcugaccggccucgacugcaugcgccccugcuucugggucgagcugauccgggggcgcccccgggagaagaccacgaucuggaccagcggcuccucgaucuccuucugcggggugaacagcgacaccgugaacugguccuggcccgacggcgccgagcugccguucaccaucgacaaguga

SEQ ID NO: 25897 - RNA, 1413 nt, Artificial Sequence; identical to SEQ ID NO: 18859
  derived and/or modified CDS sequence (AUadapt) from InfluenzaA__AGQ47826__NA

SEQ ID NO: 25898 - RNA, 1410 nt, Artificial Sequence
  derived and/or modified CDS sequence (AUadapt) from InfluenzaA__AGQ47838__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaucugccccaagcuggugggguaccggaacugguccaagccgcagugcaagaucacgggcuucgcccccuucagcaaggacaacuccauccgccugucggccgggggcgacaucugggugacccgggagcccuacgucuccugcgaccccgggaagugcuaccaguucgcccucggccagggcaccacccuggacaacaagcacagcaacgacacgauccacgaccgcaccccgcaccggacccugcucaugaacgagcugggggugcccuuccaccugggcaccaagcaggucugcaucgccugguccucguccucgugccacgacgggaaggcguggcuccacgugugcgugacgggcuacgacaagaacgccaccgccuccuucaucuacgacgggcgccugguggacagcaucggcuccuggucgcagaacauccugcggacccaggaguccgagugcgucugcaucaacgggaccugcacgguggugaugaccgacggcagcgccuccggccgcgcggacaccaagauccucuucaucgaggaggggaagaucguccacaucucgccccugucgggcuccgcccagcacguggaggagugcagcugcuacccccgguacccgggcgugcgcugcaucugccgggacaacuggaagggguccaaccgccccgucguggacaucaacgugaaggacuacucgaucgacuccagcuacgucugcuccggccuggugggggacacgccccggaacaacgaccgcucguccucguccuacugccggaaccccaacaacgagaagggcaaccacggggugaagggcugggccuucgacgacggcaacgacgucuggauggggcgcaccaucagcgaggacucccggucgggcuacgagaccuucaaggugaucgggggcugguccaccccgaacagcaagcuccagaucaaccgccaggucaucguggacuccgacaaccggucgggguacuccggcaucuucucgguggagggcaagagcugcaucaaccgcugcuucuacgucgagcugauccgggggcgcgagcaggagacccgcgugugguggacguccaacucgaucguggucuucugcggcaccuccgggaccuacggcaccgggagcuggcccgacggcgccgacaucaaccugaugcccaucuga

SEQ ID NO: 25899 - RNA, 1362 nt, Artificial Sequence
  derived and/or modified CDS sequence (AUadapt) from InfluenzaA__AGQ47850__NA
augaaucccaaccaaaagaucaucaccaucggcagcaucugcaugguggucgggaucaucucccugauccuccagaucggcaacaucaucagcaucuggaucucccacagcauccaggccggguccaguaccugggugaaccagacguacgugaacaucuccaacaccaacgucguggccggcccggacgcgaccagcgugauccugaccgggaacuccagucugugccccauccgcggcugggccaucuacuccaaggacaacggcauccggaucgggagcaagggcgacaucuucgucauccgcgagcccuucaucuccuguagccaccucgagugccgggccuucuuccugacgcagggggcccugcucaacgacaagcacuccaauggcaccgugaaggaccgcagccccuaccgggcccugauguccugcccggugggggaggcgcccagccccuacaacucccgcuucgagagugucgccuggagcgccuccgccugccacgacggcaugggcuggcugaccaucgggaucagcggccccgacaacggggcgguggccgugcucaaguauaacggcaucaucaccgagacgaucaaguccuggcggaagaagauccugcgcacccaggagagcgagugcgccugcgucaacggcuccugcuucaccaucaugaccgacgggccgagugacggccccgccuccuacaagaucuucaagaucgagaaagggaaggugaccaagagcaucgagcuggacgcccccaacucccacuacgaggaguguagcugcuaccccgacacgggcaaggugaugugcgucugccgggacaacuggcauggguccaaccgcccgugggugagcuucgaccagaaccucgacuaccagaucggcuacaucuguuccggcguguucggggacagcccccggcccaaggacggcaccggguccugcggccccgucagcguggacggggcgaauggcgugaagggcuucuccuaccgcuacgggaacggcgucuggaucgggcggaccaagagcaaguccagccgccacggcuucgagaugaucugggauccgaacggguggacggagaccgacagccgguucuccgugcgccaggacguggucgccaugaccgacuggagcggcuacuccggcaguuucgugcagcaccccgagcugaccgggcuggacugcaugcggcccugcuucugggucgagcucauccgcggccagcccaaggagaagacgaucuggaccuccgggagcuccaucagcuuuugcggcgugaacuccgacaccguggacuggagcuggccggacggcgccgagcugcccuucaccaucgacaaguga

SEQ ID NO: 25900 - RNA, 1410 nt, Artificial Sequence
  derived and/or modified CDS sequence (AUadapt) from InfluenzaA__AGQ47873__NA
augaacaccaaccagcgcaccaucacgaucggcaccaucugccugaucguggggaucaucucgcuccugcugcagaucggcaacaucauccuccuguggaugucccacagcauccagaccggggagaagucccaccccaaggucugcaaccagagcgugaucaccuacgagaacaacacgugggugaaccagaccuacgucaacaucuccaacaccaacaucgccgccggccagggggugaccccgaucauccuggcgggcaacagcucccucugccccaucagcggcugggccaucuacuccaaggacaacucgauccggaucggguccaagggcgacaucuucgugaugcgcgagcccuucaucagcugcucccaccuggagugccggacguucuuccugacccagggggcccuccugaacgaccgccacagcaacggcaccgucaaggaccggucccccuaccgcacccugaugagcugcccgaucggggaggcccccucccccuacaacagccgguucgaguccguggccuggagcgcgucggccugccacgacggcaugggcuggcucacgaucgggaucuccggccccgacaacggggccguggccguccugaaguacaacggcaucaucaccgacaccaucaagagcuggcgcaacaagauccugcggacccaggaguccgagugcgugugcaucaacggcagcugcuucacgaucaugaccgacgggccguccaacggccaggcgagcuacaagcuguucaagauggagaaggggaagaucaucaaguccaucgagcucgacgcccccaacuaccacuacgaggagugcagcugcuaccccgacaccggcaagguggucugcgugugccgcgacaacuggcacgccuccaaccggcccugggugucguucgaccagaaccuggacuaccagaucggguacaucugcuccggcgucuucggcgacaacccgcgcagcaacgacgggaagggcaacugcgggcccgugcucuccaacggcgccaacggggugaagggcuucagcuuccgguacggcaacggggucuggaucggccgcaccaaguccaucagcucccggagcggguucgagaugaucugggaccccaacggcuggacggagaccgacuccagcuucucgaugaagcaggacaucaucgcccugaccgacugguccggguacagcggcuccuucgugcagcaccccgagcugaccggcaugaacugcauccgcccgugcuucuggguggagcucauccgggggcagcccaaggagagcacgaucuggaccuccggcagcuccaucagcuucugcggggucaacuccggcaccgcgagcugguccuggcccgacggcgccgaccugcccuucaccaucgacaaguga

SEQ ID NO: 25901 - RNA, 1410 nt, Artificial Sequence; identical to SEQ ID NO: 16317
  derived and/or modified CDS sequence (AUadapt) from InfluenzaA__AGQ47885__NA

SEQ ID NO: 25902 - RNA, 1410 nt, Artificial Sequence; identical to SEQ ID NO: 24382
  derived and/or modified CDS sequence (AUadapt) from InfluenzaA__AGQ47897__NA

SEQ ID NO: 25903 - RNA, 1410 nt, Artificial Sequence; identical to SEQ ID NO: 16337
  derived and/or modified CDS sequence (AUadapt) from InfluenzaA__AGQ47909__NA

SEQ ID NO: 25904 - RNA, 1410 nt, Artificial Sequence
  derived and/or modified CDS sequence (AUadapt) from InfluenzaA__AGQ47921__NA
augaaccccaaccagaagaucaucaccaucggcucggugucccugaccaucgccacggucugcuuccucaugcagaccgccauccuggugaccaccgugacgcugcacuucaagcaguacgagugcgacucgccggcguccaaccaggucaugcccugcgagcccaucaucaucgagcgcaacaucaccgagaucguguaccucaacaacaccaccaucgagaaggagaucugccccaagguggucgaguaccggaacuggagcaagccgcagugccagaucacgggguucgcccccuucuccaaggacaacucgauccgccuguccgccggcggggacaucugggugacccgggagcccuacgugucgugcgaccacggcaagugcuaccaguucgcccuggggcagggcaccacccucgacaacaagcacuccaacgacacgauccacgaccgcaucccccaccggacccugcugaugaacgagcucggcgucccguuccaccuggggacccgccaggugugcaucgccuggagcuccucguccugccacgacggcaaggcguggcugcacgugugcaucaccggggacgacaagaacgccacggccucguucaucuacgacggccggcucgucgacuccaucgggagcuggucccagaacauccugcgcacccaggagucggagugcgugugcaucaacgggaccugcaccguggucaugacggacggcuccgccucgggccgggcggacacccgcauccuguucaucgaggagggcaagaucgugcacaucagcccccucuccgggucggcccagcacguggaggagugcuccugcuacccccgguaccccggcguccgcugcaucugccgggacaacuggaagggcagcaaccgcccggugguggacaucaacauggaggacuacuccaucgacucguccuacgucugcucggggcuggugggcgacacgccccggaacgacgaccgcuccagcaacuccaacugccggaaccccaacaacgagcgcgggaaccagggcgugaaggggugggccuucgacaacggcgacgacgucuggaugggccggaccaucucgaaggaccugcgcuccggguacgagaccuucaaggugaucggcggguggucgacccccaacuccaagagccagaucaaccggcaggucaucguggacuccgacaaccgcucgggcuacuccgggaucuucucgguggagggcaagagcugcaucaaccgcugcuucuacgucgagcucauccggggccgcaagcaggaggcccgggugugguggaccuccaacucgaucguggucuucugcgggaccuccggcacguacgggaccggcagcuggccggacggggccaacaucaacuucaugcccaucuga

SEQ ID NO: 25905 - RNA, 1365 nt, Artificial Sequence
  derived and/or modified CDS sequence (AUadapt) from InfluenzaA__AGQ47933__NA
augaaucccaaccagaagaucaucaccaucggcucgaucugcaugguggucgggcugaucucccucauccugcagaucggcaacaucaucagcaucuggaucucccacagcauccagaccgggucccagaaccacacgggcaucugcaaccagaacaucaucaccuacaagaacucgaccugggugaaggacaccacguccgugauccugaccgggaacagcucccucugcccgauccgcggcugggccaucuacagcaaggacaacuccauccggaucggcucgaagggggacgucuucgugauccgcgagcccuuuaucuccugcagccaccuggagugccggaccuucuuccugacccagggcgcccuccugaacgaccgccacuccaacgggacggugaaggaccggagccccuaccgcgcgcugauguccugccccgucggcgaggccccgucgcccuacaacucccgguucgagagcguggccuggagcgccuccgccugccacgacgggaugggcuggcucaccaucggcaucucggggcccgacaacggcgcgguggccguccugaaguauaacgggaucaucaccgagaccaucaaguccuggcgcaagaagauccugcggacgcaggagagcgagugcgccugcgugaacggcuccugcuucaccaucaugaccgacggccccagcgacgggcucgccuccuacaagaucuucaagaucgagaagggcaaggugaccaagucgaucgagcugaacgcgccgaacucccacuacgaggagugcagcugcuaccccgacacggggaaggucaugugcgugugccgcgacaacuggcauggcuccaaccggcccugggugagcuucgaccagaaccuggacuaccagaucggguacaucugcuccggcgucuucggcgacaacccccgcccgaaggacgggaccggcucgugcgggcccguguacguggacggcgccaacggggucaagggcuucuccuaccgguacggcaacgggguguggaucggccgcaccaagagccacuccagccggcacggguuugagaugaucugggaccccaacggcuggaccgagacggacuccaaguucucggugcgccaggacgucguggccaugaccgacuggagcggguacuccggcagcuucgugcagcaccccgagcucaccggccuggacugcauccggccgugcuucugggucgagcugauccgcgggcggcccaaggagaagaccaucuggacguccgccucguccaucagcuucugcggcgugaacuccgacaccgucaacuggagcuggcccgacggggccgagcuccccuucaccaucgacaaguga

SEQ ID NO: 25906 - RNA, 1365 nt, Artificial Sequence; identical to SEQ ID NO: 16322
  derived and/or modified CDS sequence (AUadapt) from InfluenzaA__AGQ47945__NA

SEQ ID NO: 25907 - RNA, 1365 nt, Artificial Sequence; identical to SEQ ID NO: 16322
  derived and/or modified CDS sequence (AUadapt) from InfluenzaA__AGQ47957__NA

SEQ ID NO: 25908 - RNA, 1365 nt, Artificial Sequence; identical to SEQ ID NO: 16322
  derived and/or modified CDS sequence (AUadapt) from InfluenzaA__AGQ47969__NA

SEQ ID NO: 25909 - RNA, 1365 nt, Artificial Sequence; identical to SEQ ID NO: 16322
  derived and/or modified CDS sequence (AUadapt) from InfluenzaA__AGQ47981__NA

SEQ ID NO: 25910 - RNA, 1365 nt, Artificial Sequence
  derived and/or modified CDS sequence (AUadapt) from InfluenzaA__AGQ48005__NA
augaaucccaaccagaagaucaucaccaucggcucgaucugccugguggucgggcucaucucccugauccugcagaucggcaacaucaucagcaucuggaucucccacagcauccagaccgggucccagaaccacacgggcaucugcaaccagaacaucaucaccuacaagaacagcaccugggugaaggacaccacguccgugauccucaccgggaacucgucccugugcccgauccgcggcugggccaucuacagcaaggauaacuccauccggaucggcagcaagggggacgucuucgugauccgcgagcccuucaucuccugcagccaccuggagugccggaccuucuuccucacccagggcgcccugcugaacgacaagcacuccagcgggacggugaaggaccgcucccccuaccgggcgcucaugucgugccccgucggcgaggccccgucccccuacaacagccgcuuugagagcguggccugguccgccagcgccugccacgacgggaugggcuggcugaccaucggcaucuccgggcccgacaacggcgcgguggccguccugaaguacaacgggaucaucaccgagaccaucaagagcuggcggaagaagauccuccgcacgcaggaguccgagugcgccugcgugaacggcucgugcuucaccaucaugaccgacggccccuccgacgggcuggccagcuacaagaucuucaagaucgagaagggcaaggugaccaaguccaucgagcugaacgcgccgaauagccacuacgaggagugcuccugcuaccccgacacggggaaggucaugugcgugugccgggacaacuggcacggcagcaaccgccccuggguguccuucgaccagaaccucgacuaccagaucggguacaucugcaguggcgucuucggcgacaacccccggccggaggacgggaccggcuccugcgggcccguguacguggacggcgccaacggggucaagggcuucagcuaccgcuacuccaacggcguguggaucgggcggaccaagagccacuccagccgccacggcuucgagaugaucugggaccccaacggguggaccgagacggacagcaaguuuuccgugcggcaggacgucguggccaugaccgacuggucgggcuacuccgggagcuucgugcagcaccccgagcugaccggccuggacugcaugcgcccgugcuucugggucgagcucauccggggccgccccaaggagaagaccaucuggacguccgccagcuccaucagcuucugcggggugaacuccgacaccgucgacuggagcuggcccgacggcgccgagcugcccuucuccaucgacaaguga

SEQ ID NO: 25911 - RNA, 1365 nt, Artificial Sequence; identical to SEQ ID NO: 25910
  derived and/or modified CDS sequence (AUadapt) from InfluenzaA__AGQ48017__NA

SEQ ID NO: 25912 - RNA, 1365 nt, Artificial Sequence; identical to SEQ ID NO: 16322
  derived and/or modified CDS sequence (AUadapt) from InfluenzaA__AGQ48029__NA

SEQ ID NO: 25913 - RNA, 1365 nt, Artificial Sequence
  derived and/or modified CDS sequence (AUadapt) from InfluenzaA__AGQ48041__NA
augaaucccaaccagaagaucaucaccaucggcucgaucugccugguggucgggcucaucucccugauccugcagaucggcaacaucaucagcaucuggaucucccacagcauccagaccgggucccagaaccacacgggcaucugcaaccagaacaucaucaccuacaagaacagcaccuggaucaaggacaccacguccgugauccucaccgggaacucgucccugugcccgauccgcggcugggccaucuacagcaaggauaacuccauccggaucggcagcaagggggacguguucgucauccgcgagcccuucaucuccugcagccaccuggagugccggaccuucuuccucacccagggcgcccugcugaacgacaagcacuccucggggacggugaaggaccgcucccccuaccgggcgcucaugagcugccccgugggcgaggccccgucccccuacaacagccgcuuugagagcgucgccugguccgccucggccugccacgacgggaugggcuggcugaccaucggcaucuccgggcccgacaacggcgcgguggccgugcugaaguacaacgggaucaucaccgagaccaucaagagcuggcggaagaagauccuccgcacgcaggaguccgagugcgccugcgucaacggcagcugcuucaccaucaugaccgacggccccuccgacgggcuggccagcuacaagaucuucaagaucgagaagggcaaggugaccaaguccaucgagcugaacgcgccgaauucgcacuacgaggagugcuccugcuaccccgacacggggaaggugaugugcgucugccgggacaacuggcacggcagcaaccgccccuggguguccuucgaccagaaccucgacuaccagaucggguacaucugcaguggcguguucggcgacaacccccggccggaggacgggaccggcuccugcgggcccgucuacguggacggcgccaacggggugaagggcuucagcuaccgcuacggcaacggggucuggaucggccggaccaagucccacucgucccgccacggguucgagaugaucugggaccccaacggcuggaccgagacggacagcaaguucagugugcggcaggacguggucgccaugaccgacugguccggguacagcggcuccuucgugcagcaccccgagcugaccggccuggacugcaugcgcccgugcuucuggguggagcucauccgggggcgccccaaggagaagaccaucuggacgucggccuccagcaucuccuucugcggcgucaacagcgacaccguggacugguccuggcccgacggggccgagcugcccuucagcaucgacaaguga

SEQ ID NO: 25914 - RNA, 1365 nt, Artificial Sequence
  derived and/or modified CDS sequence (AUadapt) from InfluenzaA__AGQ48053__NA
augaaucccaaccagaagaucaucaccaucggcucgaucugccugguggucgggcucaucucccugauccugcagaucggcaacaucaucagcaucuggaucucccacagcauccagaccgggucccagaaccacacgggcaucugcaaccagaacaucaucaccuacaagaacagcaccuggaucaaggacaccacguccgugauccucaccgggaacucgucccuguguccgauccgcggcugggccaucuacagcaaggacaacuccauccggaucggcagcaagggggacguguucgucauccgcgagcccuucaucuccugcagccaccuggagugccggaccuucuuccucacccagggcgcccugcugaacgacaagcacuccagcgggacggugaaggaucgcucccccuaccgggcgcucaugucgugccccgugggcgaggccccgucccccuacaacagccgcuucgagagcgucgccugguccgccagcgccugccacgacgggaugggcuggcugaccaucggcaucuccgggcccgacaacggcgcgguggccgugcugaaguacaacgggaucaucaccgagaccaucaagagcuggcggaagaagauccuccgcacgcaggaguccgagugcgccugcgucaauggcucgugcuucaccaucaugaccgacggccccuccgacgggcuggccagcuacaagaucuucaagaucgagaagggcaaggugaccaaguccaucgagcugaacgcgccgaacagccacuacgaggagugcuccugcuaccccgacacggggaaggugaugugcgucugucgggacaacuggcacggcagcaaccgccccuggguguccuucgaccagaaccucgacuaccagaucggguacaucugcucgggcguguucggcgacaacccccggccggaggacgggaccggcuccugcgggcccgucuacguggauggcgccaacggggugaagggcuucagcuaccgcuacggcaacggggucuggaucggccggaccaagucccacagcucccgccacggguucgagaugaucugggaccccaacggcuggaccgagacggacagcaaguucagcgugcggcaggacguggucgccauggccgacugguccggguauucgggcuccuucgugcagcaccccgagcugaccggccuggacugcaugcgcccgugcuucuggguggagcucauccgggggcgccccaaggagaagaccaucuggaccagcgccuccagcaucuccuucugcggcgucaacagcgacacgguggacugguccuggcccgacggggcggagcugcccuucagcaucgacaaguga

SEQ ID NO: 25915 - RNA, 1410 nt, Artificial Sequence
  derived and/or modified CDS sequence (AUadapt) from InfluenzaA__AGQ81707__NA
augaaccccaaccagaagaucaucaccaucggcucgaucugcauggugaucgggaucgccucccugaugcuccagaucggcaacaugaucagcaucugggucucccacagcauccagaccgggaaccaguaccagccggagcccugcaaccaguccaucaucacguacgagaacaacaccugggugaaccagaccuacgugaacaucagcaacaccaacuuccugacggagcaggccgucaccuccguggcgcuggccggcaacucgucccucugccccaucagcgggugggccaucuacuccaaggacaacggcauccgcaucggcagcaagggggacguguucgucauccgggagcccuucaucuccugcagccaccuggagugccgcaccuucuuccugacccagggcgcccuccugaacgacaagcacuccaacgggacggugaaggaccggagcccguaccgcacccugauguccugccccgugggcgaggcccccucgcccuacaacucccgguucgagagcgucgcguggagcgccuccgccugccacgacgggaucagcuggcucaccaucggcaucuccggcccggacaacggggccguggcggugcugaaguacaacggcaucaucaccgacacgaucaagagcuggcgcaacaacauccugcggacccaggaguccgagugcgccugcgucaacgggucgugcuucaccgugaugaccgacggccccuccaacggccaggccagcuacaagaucuucaagaucgagaaggggaagguggucaaguccguggagcucaacgcccccaacuaccacuacgaggagugcagcugcuaccccgacgccggcaagaucaugugcgugugccgcgacaacuggcacggguccaaccggccgugggucagcuucaaccagaaccuggaguaccagaucggcuacaucugcuccgggguguucggcgacaacccccgccccaacgacggcacggggagcugcggccccguguccucgaacggggcguacggcgucaagggguucuccuucaaguacggcaacggcguguggaucgggcggaccaagagcaccuccagccgcagcggcuucgagaugaucugggacccgaacggguggaccgagacggacuccagcuucuccgugaagcaggacaucgucgccaucaccgacuggucgggcuacuccgggagcuucgugcagcaccccgagcugaccggccucgacugcaugcggcccugcuucugggucgagcugauccgcggccggcccaaggagaacaccaucuggacguccgggagcuccaucagcuucugcggcguggacuccgacaccgugggguggagcuggccggacggcgccgagcugcccuucaccaucgacaaguga

SEQ ID NO: 25916 - RNA, 1410 nt, Artificial Sequence
  derived and/or modified CDS sequence (AUadapt) from InfluenzaA__AGQ81715__NA
augaaucccaaccagaagaucaucgccaucggcucggugucccugaccaucgccaccaucugccuccugaugcagaucgcgauccuggucacgaccaugacccuccacuucaagcacaacgagugcaccaacucguccaacaaccaggccgugccgugcgggcccaucaucaucgagcgcaacgugacggagaucguccaccugaacagcaccacccuggagaaggagaucugccccaaggccgccggcuaccgggacugguccaagccccagugccagaucaccggguucgccccguucucgaaggacaacuccauccgccucagcgcguccggcgacaucugggugacgcgggagcccuacgugucgugcgggcugggcaagugcuaccaguucgcccugggccaggggaccacccucgacaaccgccacuccaacggcaccucgcacgaccggacgcccuaccgcacccugcugaugaacgagcucgggguccccuuccaccuggccaccaagcaggucugcaucgccugguccagcuccucgugccacgacggcaaggcguggcugcacgugugcgugaccggggacgaccggaacgccacggccuccaucaucuacgacggcauccucguggacagcaucggcuccuggucgaagaacauccugcgcacccaggagucggagugcgugugcaucaacgggaccugcaccgucgugaugacggacggcuccgccagugggaaggccgacacccggauccuguucauccgcgagggcaagaucgugcacaucuccccgcucucgggcuccgcgcagcacgucgaggagugcagcugcuacccccaguaccccgaggugcggugcgugugccgcgacaacuggcggggguccaaccgccccguccuguacaucaacauggccgacuacucgaucgacuccggcuacgugugcucggggcuggugggcgacaccccgcggaacgacgacaucuccagcuccucgaacugcaaggaccccaacaacgagcgcggggcccccggcgucaagggcugggccuucgacuccgggaacgacaucuggaugggccggaccaucgagaaggacagccgcuccggguacgagacguuccgggugaucggcggguggaacaccgccaacucgaagucccagaccucgcgccaggugaucgucgacagcggcaacuccucgggcuacuccgggaucuucagcaucgagggcaaguccugcaucaaccggugcuucuacguggagcucauccgcgggcgccccaaggagacccgggucugguggacgucgaacuccaucaucguguucugcggcaccagcgggaccuacggcaccggcuccuggccggacggggcgaacaucaacuucauggccaucuga

SEQ ID NO: 25917 - RNA, 1410 nt, Artificial Sequence
  derived and/or modified CDS sequence (AUadapt) from InfluenzaA__AGQ81717__NA
augaaucccaaccagaagaucaucgccaucggcucggugucccugaccaucgccaccaucugccuccugaugcagaucgcgauccuggucacgaccaugaccccgcacuucaagcacgacgagugcaccaacucguccaacaaccaggccgugcccugcgggcccaucaucaucgagcgcaacgugacggagaucguccacaucaacagcaccauccucgagaaggagaucugccccaaggccgccggcuaccggaacugguccaagccgcagugccagaucaucggguucgcccccuucucgaaggacaacuccauccgccugucggcguccggcgacaucugggugacccgggagcccuacgugagcugcgggcugggcaagugcuaccaguucgcccucggccaggggaccacgcuggacaaccgccacuccaacggcaccucgcacgaccggacgccccaccgcacccugcucaugaacgagcugggggucccguuccaccuggccaccaagcaggucugcaucgccugguccucguccagcugccacgacggcaaggcguggcuccacgugugcgugaccggggacgaccggaacgccaccgccuccaucaucuacgacggcaugcugguggacucgaucggcuccuggagcaagaacauccugcgcacccaggagucggagugcgugugcaucaacgggacgugcaccgucgugaugaccgacggcuccgccucggggaaggccgacacccggauccucuucauccgcgagggcaagaucgugcacaucagcccccuguccggcuccgcgcagcacgucgaggagugcucgugcuacccccaguaccccgaggugcggugcgugugccgcgacaacuggcggggguccaaccgcccgguccuguacaucaacauggccgacuacucgaucgacuccggcuacgugugcagcgggcucgugggcgacacgccccggaacgacgacaucuccucguccagcaacugcaaggaccccaacaacgagcgcggggcccccggcgucaagggcugggccuucgacuccgggaacgacaucuggaugggccggaccaucgagaaggacucgcgcuccggguacgagaccuuccgggugaucggcggguggaacaccgccaacucgaagucccagacgagccgccaggugaucgucgacucggacaacuccucgggcuacuccggcaucuucagcguggaggggaaguccugcaucaaccggugcuucuacgucgagcugauccgcggccgcccgaaggagacccgggugugguggaccucgaacuccaucaucguguucugcgggaccagcggcacguacgggaccggcuccuggcccgacggcgcgaacaucaacuucauggccaucuga

SEQ ID NO: 25918 - RNA, 1410 nt, Artificial Sequence
  derived and/or modified CDS sequence (AUadapt) from InfluenzaA__AGQ81718__NA
augaaucccaaccagaagaucaucgccaucggcucggugucccugaccaucgccaccaucugccuccugaugcagaucgcgauccuggucacgaccaugacccuccacuucaagcacaacgagugcaccaacagcuccaacaaccaggccgugccgugcgggcccaucaucaucgagcgcaaccugacggagaucgugcaccugaacucgaccauccucgagaaggagaucugccccaaggccgccggcuaccggaacugguccaagccccagugccagaucaccggguucgccccguucagcaaggacaacuccauccgccugucggcguccggcgacaucugggucacccgggagcccuacgugagcugcgggcugggcaagugcuaccaguucgcccucggccaggggacgacccuggauaaccgccacuccaacggcaccucgcacgaccggacgccccaccgcacccugcucaugaacgagcugggggugcccuuccaccuguccaccaagcaggucugcaucgccuggagcuccucguccugccacgacggcaaggccuggcuccacgugugcgugaccggggacgaccggaacgcgaccgccagcaucaucuacgacggcauccuggucgacuccaucgugucguggagcaagaacauccugcgcacgcaggaguccgagugcgugugcaucaacgggaccugcaccgucgugaugaccgacggcucggccuccggcaaggccgauacgcggauccucuucauccgcgaggggaagaucgugcacaucagcccgcuguccggcucggcccagcacgucgaggagugcuccugcuacccccgguaccccgaggugcgcugcgugugccgggacaacuggcgcggcagcaaccggcccguccuguacaucaacauggcggacuacuccaucgacucgggguacgugugcuccggccucgugggggacaccccgcgcaacgacgacaccagcuccucguccaacugccgggaccccaacaacgagcgcggcgcccccggggucaagggcugggccuuugacagcggcaacgacaucuggauggggcggaccaucgagaaggacucccgcucgggcuacgagacguuccgggugaucgggggcuggaacaccgccaacuccaagagccagaccucgcgccaggugaucgucgacuccgacaacagcuccggguacucgggcguguucuccgucgagggcaagagcugcaucaaccgcugcuucuacguggagcugauccgggggcgccccaaggagacccgggugugguggacguccaacucgaucaucgucuucugcggcaccuccgggaccuacggcaccgggagcuggccggacggcgccaacaucaacuucauggcgaucuga

SEQ ID NO: 25919 - RNA, 1410 nt, Artificial Sequence
  derived and/or modified CDS sequence (AUadapt) from InfluenzaA__AGQ81719__NA
augaaccccaaccagaagaucaucgccaucggcucggugucccugaccaucgccaccaucugccuccugaugcagaucgcgauccuggucacgaccaugacccuccacuucaagcacaacgagugcaccaacucguccaacaaccaggccgugccgugcgggcccaucaucaucgagcgcaacgugacggagaucguccaccugaacucgaccacccuggagaaggagaucugcaccaaggccgccggcuaccgggacugguccaagccccagugccagaucacgggguucgcccccuucagcaaggacaacuccauccgccucucggcguccggcgacaucugggugacccgggagccguacgugucgugcgggcugggcaagugcuaccaguucgcccugggccaggggaccacccucgacaaccgccacuccaacggcacgacccacgaccggacgccccaccgcacccugcugaugaacgagcucgggguccccuuccaccuggccaccaagcaggucugcaucgccuggucguccagcuccugccacgacggcaaggcguggcugcacgugugcgugaccggggacgaccggaacgccaccgccucgaucaucuacgacggcauccucguggacuccaucggcucgugguccaagaacauccugcgcacccaggagucggagugcgugugcaucaacgggacgugcaccgucgugaugaccgacggcagcgccuccgggaaggccgacacccggauccuguucauccgcgagggcaagaucgugcacaucucgccccucuccggcucggcgcagcacgucgaggagugcuccugcuacccgcaguaccccgaggugcggugcgugugccgcgacaacuggcgggggucgaaccgccccguccuguacaucaacauggccgacuacuccaucgacagcggcuacgugugcuccgggcuggugggcgacacgccccggaacgacgacaucucguccaacucgaacugcaaggacccgaacaacgaguccggggcccccggcgucaagggcugggccuucgacucggggaacgacaucuggaugggccgcaccaucgagaaggacucccggagcggguacgagaccuuccgcgugaucggcggguggaacaccgccaacuccaagucgcagacgucccgccaggugaucgucgacucggacaacucguccggcuacagcggcaucuucuccaucgagggcaagucgugcaucaaccggugcuucuacguggagcucauccgggggcgccccaaggagacccgcgucugguggaccuccaacucgaucaucguguucugcgggaccuccggcacguacgggaccggcagcuggcccgacggcgcgaacaucaacuucauggccaucuga

SEQ ID NO: 25920 - RNA, 1410 nt, Artificial Sequence
  derived and/or modified CDS sequence (AUadapt) from InfluenzaA__AGQ81722__NA
augaaucccaaccagaagaucaucgccaucggcucggugucccugaccaucgccaccaucugccuccugaugcagaucgcgauccuggucacgaccaugaccccgcacuucaagcacgacgagugcaccaacucguccaacaaccaggccgugcccugcgggcccaucaucaucgagcgcaacgugacggagaucguccacaucaacagcaccauccucgagaagggcaucugccccaaggccgccggguaccggaacugguccaagccgcagugccagaucaucggcuucgcccccuucucgaaggacaacuccauccgccugagcgcguccggggacaucugggugacccgggagcccuacgugucgugcggccugggcaagugcuaccaguucgcccucgggcagggcaccacgcuggacaaccgccacuccaacgggaccucgcacgaccggacgccccaccgcacccugcucaugaacgagcugggcgucccguuccaccuggccaccaagcaggucuguaucgccugguccagcuccucgugccacgacgggaaggcguggcuccacgugugcgugaccggcgacgaccggaacgccaccgccuccaucaucuacgacggcaugcugguggacagcaucggguccuggucgaagaacauccugcgcacccaggagucggagugcgugugcaucaacggcacgugcaccgucgugaugaccgacggguccgccagcggcaaggccgacacccggauccucuucauccgcgagggcaagaucgugcacaucucgccccuguccggguccgcgcagcacgucgaggagugcagcugcuacccccaguaccccgaggugcggugcgugugccgcgacaacuggcggggcuccaaccgcccgguccuguacaucaacauggccgacuacucgaucgacuccggguacgugugcaguggccucgugggggacacgccccggaacgacgacaccuccagcuccucgaacugcaaggaccccaacaacgagcgcggcgcccccggcgucaaggggugggccuucgacuccggcaacgacaucuggauggggcggaccaucgagaaggacagccgcuccggcuacgagaccuuccgggugaucgggggcuggaacacggccaacucgaagucccagaccucgcgccaggugaucgucgacagcgacaacuccucgggcuacuccgggaucuucagcguggagggcaaguccugcaucaaccggugcuucuacgucgagcugauccgcgggcgcccgaaggagacccgggugugguggaccucgaacuccaucaucguguucugcggcacgagcgggaccuacggcaccggcuccuggcccgacggggcgaacaucaacuucauggccaucuga

SEQ ID NO: 25921 - RNA, 1410 nt, Artificial Sequence
  derived and/or modified CDS sequence (AUadapt) from InfluenzaA__AGQ81724__NA
augaaucccaaccagaagaucaucgccaucggcucggugucccugaccaucgccaccaucugccuccugaugcagaucgcgauccuggucacgaccaugacccuccacuucaagcacaacgagugcucgaacuccagcaacaaccaggccgugccgugcgggcccaucaucaucgagcgcaacgugaccgagaucguccaccugaacuccacgacccuggagaaggagaucugccccaaggccgccggcuaccgggacuggucgaagccccagugccagaucaccggguucgccccguucuccaaggacaacagcauccgccucuccgcgucgggcgacaucugggugacccgggagcccuacguguccugcgggcugggcaagugcuaccaguucgcccugggccaggggacgacccucgacaaccgccacagcaacggcaccucccacgaccggacgccccaccgcacccugcugaugaacgagcucgggguccccuuccaccuggccaccaagcaggucugcaucgccuggaguuccucguccugccacgacggcaaggcguggcugcacgugugcgugaccggggacgaccggaacgccaccgccagcaucaucuacgacggcauccucguggacuccaucggcucguggagcaagaacauccugcgcacgcaggaguccgagugcgugugcaucaacgggaccugcaccgucgugaugaccgacggcucggccuccgggaaggccgacacgcggauccuguucauccgcgagggcaagaucgugcacaucagcccgcucuccggcucggcgcagcacgucgaggagugcuccugcuacccccaguaccccgaggugcggugcgugugccgcgacaacuggcgggggucgaaccgccccguccuguacaucaacauggaggacuacuccaucgacagcggcuacgugugcuccgggcuggugggcgauaccccgcggaacgacgacaucucguccagcuccaacugcaaggaccccaacaacgagcgcggggcccccggcgucaagggcugggccuucgacucggggaacgaccucuggaugggccggaccaucgagaaggacucccgcagcggguacgagaccuuccgggugaucggcggguggaacacggccaacuccaagucgcagaccucgcgccaggugaucgucgacuccgacaacagcuccggcuacucgggcaucuucuccguggagggcaagagcugcaucaaccggugcuucuacgucgagcugauccgcgggcgccccaaggagacccgggugugguggaccuccaacucgaucaucguguucugcgggacguccggcaccuacgggaccggcagcuggccggacggcgccaacaucaacuucauggcgaucuga

SEQ ID NO: 25922 - RNA, 1410 nt, Artificial Sequence
  derived and/or modified CDS sequence (AUadapt) from InfluenzaA__AGQ81726__NA
augaaucccaaccagaagaucaucgccaucggcucggugucccugaccaucgccaccaucugccuccugaugcagaucgcgauccuggucacgaccaugacccuccacuucaagcacaacgagugcucgaacuccagcaacaaccaggccgugccgugcgggcccaucaucaucgagcgcaacaucaccgagaucgugcaccugaacuccacgacccuggagaaggagaucugccccaaggccgccggcuaccgggacuggucgaagccccagugccagaucaccggguucgccccguucuccaaggacaacagcauccgccucuccgcgucgggcgacaucugggucacccgggagcccuacguguccugcgggcugggcaagugcuaccaguucgcccugggccaggggacgacccucgacaaccgccacagcaacggcaccucccacgaccggacgccccaccgcacccugcugaugaacgagcucggggugcccuuccaccuggccaccaagcaggucuguaucgccuggucguccucguccugccacgacggcaaggcguggcugcacgugugcgugaccggggacgaccggaacgccaccgccagcaucaucuacgacggcauccucgucgacuccaucggcucguggagcaagaacauccugcgcacgcaggaguccgagugcgugugcaucaagcggaccugcaccguggucaugaccgacgggucggccuccggcaaggccgacacgcgcauccuguucauccgggaggggaagaucgugcacaucagcccgcucuccggcucggcgcagcacguggaggagugcuccugcuacccccaguaccccgagguccgcugcgugugccgggacaacuggcgcggcucgaaccggcccgugcuguacaucaacauggccgacuacuccaucgacagcggguacgucuguuccggccuggugggggacaccccgcgcaacgacgacaucucguccagcuccaacugcaaggaccccaacaacgagcggggcgcccccggggugaagggcugggccuucgacucgggcaacgaccucuggauggggcgcaccaucgagaaggagucccggagcggcuacgagaccuuccgcgucaucgggggcuggaacacggccaacuccaagucgcagaccucgcgccaggugaucguggacuccgacaacagcuccggguacucgggcaucuucuccgucgagggcaagagcugcaucaaccggugcuucuacguggagcugauccgcgggcggcccaaggagacccgcgucugguggaccuccaacucgaucaucguguucugcggcacguccgggaccuacggcaccgggagcuggccggacggcgcgaacaucaacuucauggccaucuga

SEQ ID NO: 25923 - RNA, 1410 nt, Artificial Sequence
  derived and/or modified CDS sequence (AUadapt) from InfluenzaA__AGQ81727__NA
augaaucccaaccagaagaucaucgccaucggcucggugucccugaccaucgccaccaucugccuccugaugcaggucgcgauccuggugacgaccaugacccuccacuucaagcacaacgagugcagcaacuccucgaacaaccaggccgugccgugcgggcccaucaucaucgagcgcaacaucaccgagaucguccaccugaacuccacgacccuggagaaggagaucugccccaaggccgccggcuaccgggacuggagcaagccccagugccagaucaccggguuugccccguucuccaaggacaacucgauccgccucuccgcgagcggcgacaucugggugacccgggagcccuacguguccugcgggcugggcaagugcuaccaguucgcccugggccaggggacgacccucgacaaccgccacucgaacggcaccucccacgaccggacgccccaccgcacccugcugaugaacgagcucgggguccccuuccaccuggccaccaagcaggucuguaucgccuggagcuccucguccugccacgacggccgggcguggcugcacgugugcgugaccggggacgaccgcaacgccaccgccagcaucaucuacgacggcauccucguggacuccaucggcucguggagcaagaacauccugcggacgcaggaguccgagugcgugugcaucaacgggaccugcaccgucgugaugaccgacggcucggccuccgggaaggccgauacgcgcauccuguucauccgggagggcaagaucgugcacaucagcccgcucuccggcagcgcgcagcacgucgaggagugcuccugcuacccccaguaccccgaggugcgcugcgugugccgggacaacuggcgcgggucgaaccggcccguccuguacaucaacauggccgacuacuccaucgacagcggcuacguguguuccgggcuggugggcgacaccccgcgcaacgacgacaucucguccagcuccaacugcaaggaccccaacaacgagcgcggggcccccggcgucaagggcugggccuucgacucggggaacgaccucuggaugggccggaccaucgagaaggagucccggagcggguacgagaccuuccgcgugaucggcggguggaacacggccaacuccaagucgcagaccagucgccaggugaucgucgacuccgacaacucguccggcuacagcggcaucuucuccguggagggcaagucgugcaucaaccggugcuucuacgucgagcugauccgcgggcggcccaaggagacccgcgugugguggaccuccaacagcaucaucguguucugcgggacguccggcaccuacgggaccggcagcuggccggacggcgcgaacaucaacuucaugcccaucuga

SEQ ID NO: 25924 - RNA, 1410 nt, Artificial Sequence
  derived and/or modified CDS sequence (AUadapt) from InfluenzaA__AGQ81728__NA
augaaucccaaccagaagaucguggccaucggcucggucucccugaccaucgccaccaugugccuccugaugcagaucgcgcuguucgccacgaccaugacccuccacuucaagcagaccgggucgacgaacuccagcgacaaccaggccgugccgugcggccccaucaucaucgagcgcaacaucaccgagaucgugcaccugaacuccaccacccuggagaaggagacgugccccaagucggccggguaccggaacugguccaagccccagugccagaucaccggcuucgccccguucucgaaggacaacuccauccgccucagcgcgggcggcgacaucugggucacccgggagcccuacguguccugcggccuggggaagugcuaccaguucgcccugggccaggggaccacgcucgacaacaagcacucgaacggcaccaccuacgaccgcacgccccaccggacccugcugaugaacgagcucggggugcccuuccaccuggccaccaagcaggucugcaucgccugguccucguccaguugccacgacggcaaggcguggcugcacgugugcgugaccggcgacgacaagaacgccaccgccuccaucaucuacgacgggauccucgucgacucgaucgccuccuggagcaagaacauccugcgcacgcaggagucggagugcgugugcaucaacgggaccugcaccguggucaugaccgacggguccgccucgggccgggcggacacgcgcauccuguucauccgggagggcaagaucgugcacaucuccccgcucagcggguccgcccagcacguggaggagugcucgugcuacccccgcuaccccgagguccggugcgugugccgcgacaacuggaagggcuccaaccggcccgugcuguacaucaacauggccgacuacucgaucgacuccagcuacgucugcuccgggaucgugggcgauaccccgcgcaacgacgaccggucguccagcuccaacugccgcgaccccaacaacgagaucggggcccccggcgugaagggcugggccuucgacucggggaacgacaucuggaugggccggaccaucgagaaggacucccgcucgggguacgagaccuuccgggucaucggcgggugguccacggcgaacagcaagucgcagaucaaccgccaggugaucguggaccgggacaacuccucgggcuacuccggcaucuucagcgucgaggggaaguccugcaucaaccgcugcuucuacguggagcugauccgcggccggcccaaggagaaccgcgucugguggaccucgaacuccaucaucguguucugcgggaccagcggcaccuacgggacgggcuccuggccggacggcgccaacaucaaccucaugcccaucuga

SEQ ID NO: 25925 - RNA, 1410 nt, Artificial Sequence
  derived and/or modified CDS sequence (AUadapt) from InfluenzaA__AGQ81729__NA
augaaucccaaccagaagaucaucgccaucggcucggugucccugaccaucgccaccaucugccuccugaugcagaucgcgauccuggucgccacgaugacccuccacagcaagcacggggagugcaccaacuccucgaacaaccaggccgugccgugcggccccaucaucaucgagcgcaacgugaccgagaucguccaccugaacuccacgacccuggagaaggagaucugccccaaggccgccggguaucgggacuggagcaagccccagugccagaucaccggcuucgcgccguucuccaaggacaacucgauccgccucuccgccagcggggacaucugggugacccgggagcccuacguguccugcggccugggcaagugcuaccaguucgcccuggggcagggcacgacccucgacaaucgccacucgaacgggaccucccacgaccggacgccccaccgcacccugcugaugaacgagcucggcauccccuuccaccuggccaccaagcaggucugcaucgcguggagcuccucguccugccacgacgggaaggccuggcugcacgugugugugaccggcgacgaccggaacgccaccgccagcaucaucuacgacggcaugcucgucgacuccaucgggucguggagcaagaacauccugcgcacgcaggaguccgagugcgugugcaucaacgggaccugcaccguggucaugaccgacggcucggccuccggcaaggcggacacgcggauccuguuuauccgcgagggcaagaucgugcacaucagcccgcuccugggguccgcccagcacguggaggagugcucgugcuacccccaguaccccgagguccggugcgugugccgcgacaacuggcggggcuccaaccgccccgugcuguacaucaacauggccgacuauagcgucgacuccggguacgugugcucgggccucgugggggacaccccgcggaacgacgacaccuccagcuccucgaacugcaaggaccccaacaacgagcgcggcgcccccggcgucaaggggugggccuuugacuccggcaacgacaucuggauggggcggaccaucgagaaggacagccgcuccggcuacgagacguuccgggugaucgggggcuggaacaccgcgaacucgaagucccagaccagccgccaggugaucgucgacucggacaacuccagcggcuauuccgggaucuucucgguggagggcaaguccugcaucaaccggugcuucuacgucgagcugauccgcgggcgccccaaggagacccgggugugguggacgagcaacuccaucaucguguucugcggcaccagcgggaccuacggcaccggcuccuggccggacggggccaacaucaacuucaugcccaucuga

SEQ ID NO: 25926 - RNA, 1410 nt, Artificial Sequence
  derived and/or modified CDS sequence (AUadapt) from InfluenzaA__AGQ81730__NA
augaaucccaaccagaagaucaucgccaucggcucggugucccugaccaucgccaccaucugccuccugaugcagaucgcgauccuggucacgaccaugacccuccacuucaagcacaacgagugcaucaacucguccaacaaccagagcgugccgugcgggcccaucaucaucgagcgcaacgugaccgagaucguccaccugaacuccacgacccuggagaaggagaucugccccaaggccgccggcuaccgggacuggucgaagccccagugccagaucaccggguucgccccguucuccaaggacaacagcauccgccucuccgccucgggcgacaucugggugacccgggagcccuacguguccugcgggcugggcaagugcuaccaguucgcgcugggccaggggacgacccucgacaaccgccacagcaacggcaccucccacgaccggacgccccaccgcacccugcugaugaacgagcucgggguccccuuccaccuggccucgaagcaggucugcaucgccugguccagcuccucgugccacgacggcaaggccuggcugcacgugugcgugaccggggacgaccggaacgcgaccgccuccaucaucuacgacggcaugcucguggacagcaucggcucgugguccaagaacauccugcgcacccaggagagcgagugcgugugcaucaacgggacgugcaccgucgugaugaccgacggcuccgccaguggggaggccgacacccggauccuguucauccgcgagggcaagaucgugcacaucuccccgcucucgggcuccgcccagcacgucgaggagugcagcugcuacccccaguaccccgaggugcggugcgugugccgcgacaacuggcggggguccaaccgccccguccuguacaucaacauggcggacuacucgaucgacuccggcuacgugugcagcgggcuggugggcgacacgccgcggaacgacgacaucuccucguccagcaacugcaaggaccccaacaacgagcgcggggcccccggcgucaagggcugggccuucgacuccgggaacgacaucuggaugggccggaccaucgagaaggacucgcgcuccggguacgagaccuuccgggugaucggcggguggaacaccgccaacagcaagucgcagacgucccgccaggugaucgucgacagcgacaacuccucgggcuacuccggcaucuucagcguggaggggaaguccugcaucaaccggugcuucuacgucgagcucauccgcggccgccccaaggagacccgggugugguggaccucgaacuccaucaucguguucugcgggaccagcggcacguacgggaccggcuccuggccggacggcgccaacaucaacuucauggcgaucuga

SEQ ID NO: 25927 - RNA, 1410 nt, Artificial Sequence
  derived and/or modified CDS sequence (AUadapt) from InfluenzaA__AGQ81731__NA
augaaccccaaccagaagaucaucgccaucggcucggugucccugaccaucgccaccaucugccuccugaugcagaucgcgauccuggucacgaccaugacccuccacuucaagcacaacgagugcucgaacuccagcaacaaccaggccgugccgugcgggcccaucaucaucgagcgcaacaucaccgagaucgugcaccugaacuccacgacccuggagaaggagaucugccccaagaccgccggcuaccgggacuggucgaagccccagugccagaucaccggguucgccccguucuccaaggacaacucgauccgccucuccgccagcggcgacaucugggucacgcgggagcccuacguguccugcggguucggcaagugcuaccaguucgcgcugggccaggggaccacccuggacaaccgccacucgaacggcaccucccacgaccggacgccccaccgcacccuccugaugaacgagcugggggugcccuuccaccucgccaccaagcaggucugcaucgccuggucguccagcuccugccacgacggcaaggccuggcugcacgugugcgugaccggggacgaccggaacgcgacggccucgaucaucuacgacggcauccuggucgacuccaucggcucguggagcaagaacauccuccgcacccaggaguccgagugcgugugcaucaacgggaccugcaccguggucaugacggacggcucggccuccgggaaggccgacacccggauccuguucauccgcgagggcaagaucgugcacaucagcccgcuguccggcucggcccagcacguggaggagugcuccugcuacccccaguaccccgagguccggugcgugugccgcgacaacuggcgggggucgaaccgccccgugcucuacaucaacaugaccgacuacuccaucgacagcggcuacgucugcuccgggcuggugggcgacaccccgcggaacgacgacaucucguccucguccaacugcaaggaccccaacaacgagcgcggggcgcccggcgugaagggcugggccuucgacagcgggaacgaccuguggaugggccggacgaucgagaaggagucccgcucgggguacgagaccuuccgggucaucggcggguggaacaccgccaacuccaagucgcagaccagccgccaggugaucguggacuccgacaacucguccggcuacucgggcaucuucuccgucgagggcaagagcugcaucaaccggugcuucuacguggagcucauccgcgggcgccccaaggagacgcgggucugguggaccuccaacucgaucaucguguucugcgggaccuccggcaccuacgggacgggcagcuggccggacggcgccaacaucaacuucauggccaucuga

SEQ ID NO: 25928 - RNA, 1410 nt, Artificial Sequence
  derived and/or modified CDS sequence (AUadapt) from InfluenzaA__AGQ81732__NA
augaaucccaaccagaagaucaucgccaucggcucggugucccugaccaucgccaccaucugccuccugaugcaggucgcgauccuggugacgaccaugacccuccacuucaagcacaacgagugcucgaacuccagcaacaaccaggccgugccgugcgggcccaucaucaucgagcgcaacaucaccgagaucguccaccugaacuccacgacccuggagaaggagaucugccccaaggccgccggcuaccgggacuggucgaagccccagugccagaucaccggguucgccccguucuccaaggacaacagcauccgccucuccgcgucgggcgacaucugggugacccgggagcccuacguguccugcgggcugggcaagugcuaccaguucgcccugggccaggggacgacccucgauaaccgccacagcaacggcaccucccacgaccggacgccccaccgcacccugcugaugaacgagcucgggguccccuuccaccuggccaccaagcaggucugcaucgccuggucguccagcuccugccacgacggcaaggcguggcugcacgugugcgugaccggggacgaccggaacgccaccgccucgaucaucuacgacggcauccucguggacuccaucggcagcuggucgaagaacauccugcgcacgcaggaguccgagugcgugugcaucaacgggaccugcaccgucgugaugaccgacggcagcgccuccgggaaggccgauacgcggauccuguucauccgcgagggcaagaucgugcacaucucgccgcucuccggcucggcgcagcacgucgaggagugcuccugcuacccccaguaccccgaggugcggugcgugugccgcgacaacuggcgggggagcaaccgccccguccuguacaucaacauggccgacuacuccaucgacucgggcuacgugugcuccgggcuggugggcgacaccccgcggaacgacgacaucagcuccucguccaacugcaaggaccccaacaacgagcgcggggcccccggcgucaagggcugggccuuugacagcgggaacgaccucuggaugggccggaccaucgagaaggagucccgcucgggguacgagaccuuccgggugaucggcggguggaacacggccaacuccaagagccagaccucgcgccaggugaucgucgacuccgacaacagcuccggcuacucgggcaucuucuccguggagggcaagagcugcaucaaccggugcuucuacgucgagcugauccgcgggcgccccaaggagacccgggugugguggaccuccaacucgaucaucguguucugcgggacguccggcaccuacgggaccggcagcuggccggacggcgcgaacaucaacuucaugcccaucuga

SEQ ID NO: 25929 - RNA, 1410 nt, Artificial Sequence
  derived and/or modified CDS sequence (AUadapt) from InfluenzaA__AGQ81733__NA
augaaucccaaccagaagaucaucgccaucggcucggugucccugaccaucgccaccaucugccuccugaugcagaucgcgauccuggucacgaccaugacccuccacuucaagcacaacgagugcagcaacuccucgaacucccaggccgugccgugcgggcccaucaucaucgagcgcaacgugaccgagaucguccaccugaacagcacgacccuggagaaggagaucugccccaaggccgccgaguaccgggacugguccaagccccagugccagaucaccggcuucgccccguucucgaaggacaacuccauccgccucagcgcguccggggacaucugggugacccgggagcccuacgugucgugcggccuggggaagugcuaccaguucgcccugggccagggcacgacccucgauaaccgccacuccaacgggaccagccacgaccggacgccccaccgcacccugcugaugaacgagcucggcguccccuuccaccuggccaccaagcaggucugcaucgccugguccucguccagcugccacgacgggaaggcguggcugcacgugugcgugaccggcgacgaccggaacgccaccgccuccaucaucuacgacgggauccucguggacucgaucggcagcugguccaagaacauccugcgcacgcaggagucggagugcgugugcaucaacgggaccugcaccgucgugaugaccgacggcuccgccagcggcaaggccgauacgcggauccuguucauccgcgaggggaagaucgugcacaucuccccgcucucgggcuccgcgcagcacgucgaggagugcagcugcuacccccaguaccccgaggugcggugcgugugccgcgacaacuggcggggcuccaaccgccccguccuguacaucaacauggccgacuacucgaucgacuccggguacgugugcagcggccuggugggggacaccccgcggaacgacgacaucuccucguccagcaacugcaaggaccccaacaacgagcgcggcgcccccggggucaagggcugggccuuugacuccggcaacgaccucuggauggggcggaccaucgagaaggacucgcgcuccggcuacgagaccuuccgggugaucgggggcuggaacacggccaacagcaagucgcagaccucccgccaggugaucgucgacagcgacaacuccucgggguacuccggcaucuucagcguggagggcaaguccugcaucaaccggugcuucuacgucgagcugauccgcgggcgccccaaggagacccgggugugguggaccucgaacuccaucaucguguucugcggcacgagcgggaccuacggcaccggguccuggccggacggcgcgaacaucaacuucaugcccaucuga

SEQ ID NO: 25930 - RNA, 1410 nt, Artificial Sequence
  derived and/or modified CDS sequence (AUadapt) from InfluenzaA__AGQ81734__NA
augaaucccaaccagaagaucaucgccaucggcucggugucccugaccaucgccaccaucugccuccugaugcagaucgcgauccuggucacgaccaugacccuccacuucaagcacaacgaguacucgaacuccucgaacaaccaggccgugccgugcgggcccaucaucaucgagcgcaacaucaccgagaucgugcaccugaacuccacgacccuggagaaggagaucugccccaaggccgccggcuaccgggacuggagcaagccccagugccagaucaccggguucgccccguucuccaaggacaacucgauccgccucuccgcgucgggcgacaucugggucacccgggagcccuacguguccugcgggcugggcaagugcuaccaguucgcccugggccaggggacgacccucgacaaccgccacagcaacggcaccucccacgaccggacgccccaccgcacccugcugaugaacgagcucggggugcccuuccaccuggccaccaagcaggucugcaucgccuggucguccucguccugccacgacggcaaggcguggcugcacgugugcgugaccggggacgaccggaacgccaccgccagcaucaucuacgacggcauccucgucgacuccaucggcucguggucgaagaacauccugcgcacgcaggaguccaagugcgugugcaucaagcggaccugcaccguggucaagaccgacgggagcgccuccggcaaggccgacacgcgcauccuguucauccgggaggggaagaucgugcacaucucgccgcucuccggcucggcgcagcacguggaggagugcuccugcuacccccaguaccccgagguccgcugcgugugccgggacaacuggcgcggcagcaaccggcccgugcuguacaucaacauggccgacuacuccaucgacucgggguacgucugcuccggccuggugggggacaccccgcgcaacgacgacaucucguccagcuccaacugcaaggaccccaacaacgagcggggcgcccccggggugaagggcugggccuucgacucgggcaacgaccucuggauggggcgcaccaucgagaaggagucccggucgggcuacgagaccuuccgcgucaucgggggcuggaacacggccaacuccaagagccagaccucgcgccaggugaucguggacuccgacaacucguccggguacagcggcaucuucuccgucgagggcaagucgugcaucaaccggugcuucuacguggagcugauccgcgggcggcccaaggagacccgcgucugguggaccuccaacucgaucaucguguucugcggcacguccgggaccuacggcaccgggagcuggccggacggcgcgaacaucaacuucauggccaucuga

SEQ ID NO: 25931 - RNA, 1410 nt, Artificial Sequence; identical to SEQ ID NO: 25929
  derived and/or modified CDS sequence (AUadapt) from InfluenzaA__AGQ81735__NA

SEQ ID NO: 25932 - RNA, 1410 nt, Artificial Sequence
  derived and/or modified CDS sequence (AUadapt) from InfluenzaA__AGQ81736__NA
augaaucccaaccagaagaucaucgccaucggcucggugucccugaccaucgccaccaucugccuccugaugcagaucgcgauccuggucgccacgaugacccuccacagcaagcacggggagugcaccgacuccucgaacaaccaggccgugccgugcggccccaucaucaucgagcgcaacgugaccgagaucguccaccugaauuccacgacccuggagaaggagaucugccccaaggccgccggguacaaggacuggagcaagccccagugccagaucaccggcuucgcgccguucuccaaggacaacucgauccggcucuccgccagcggggacaucugggugacccgcgagcccuacguguccugcggccugggcaaguguuaccaguucgcccuggggcagggcacgacccucgacaaccggcacucgaacgggaccucccacgaccgcacgccccaccggacccugcugaugaacgagcucggcguccccuuccaccuggccaccaagcaggucugcaucgcguggagcuccaguuccugccacgacgggaaggccuggcugcacgugugcgugaccggcgacgaccgcaacgccaccgccagcaucaucuacgacggcaugcucguggacuccaucgggucguggagcaagaauauccugcggacgcaggaguccgagugcgugugcaucaacgggaccugcaccgucgugaugaccgacggcucggccuccggcaaggcggacacgcgcauccuguucauccgggagggcaagaucgcccacaucagcccgcucuccgggucggcccagcacguggaggagugcuccugcuacccccaguaucccgagguccgcugcgugugccgggacaacuggcgcggcagcaaccggcccgugcuguacaucaacauggccgacuacuccgucgacucgggguacgugugcuccggccuggugggggauaccccgcgcaacgacgacaccagcuccucguccaacugcaaggaccccaacaacgagcggggcgcccccggcgucaaggggugggcguucgacagcggcaacgacaucuggauggggcgcaccaucgagaaggauucccggucgggcuacgagacguuccgcgugaucgggggcuggaacaccgccaacuccaagagccagaccucgcgccaggugaucgucgacuccgacaacagcuccggcuacucggggaucuucuccguggagggcaagaguugcaucaaccggugcuucuacgucgagcucauccgggggcgccccaaggagacccgcgugugguggacguccaacucgaucaucguguucugcggcaccuccgggaccuacggcaccggcagcuggccggacggggccaacaucaacuucaugcccaucuga

SEQ ID NO: 25933 - RNA, 1410 nt, Artificial Sequence
  derived and/or modified CDS sequence (AUadapt) from InfluenzaA__AGQ81737__NA
augaaucccaaccagaagaucaucgccaucggcucggugucccugaccaucgccaccaucugccuccugaugcagaucgcgauccuggucacgaccaugacccuccacuucaagcacaacgagugcucgaacuccagcaacaaccaggccgugccgugcgggcccaucaucaucgagcgcaacaucaccgagaucgugcaccugaacuccacgacccuggagaaggagaucugccccaaggccgccggcuaccgggacuggucgaagccccagugccagaucaccggguucgccccguucuccaaggacaacagcauccgccucuccgcgucgggcgacaucugggucacccgggagcccuacguguccugcgggcugggcaagugcuaccaguucgcccugggccaggggacgacccucgacaaccgccacagcaacggcaccucccacgaccggacgccccaccgcacccugcugaugaacgagcucggggugcccuuccaccuggccaccaagcaggucuguaucgccuggucguccucguccugccacgacggcaaggcguggcugcacgugugcgugaccggggacgaccggaacgccaccgccagcaucaucuacgacggcauccucgucgacuccaucggcucguggagcaagaacauccugcgcacgcaggaguccgagugcgugugcaucaacgggaccugcaccguggucaugaccgacggcucggccuccgggaaggccgacacgcggauccuguucauccgcgagggcaagaucgugcacaucagcccgcucuccggcucggcgcagcacguggaggagugcuccugcuacccccaguaccccgagguccggugcgugugccgcgacaacuggcgggggucgaaccgccccgugcuguacaucaacauggccgacuacuccaucgacagcggcuacgucuguuccgggcuggugggcgacaccccgcggaacgacgacaucucguccagcuccaacugcaaggaccccaacaacgagcgcggggcccccggcgugaagggcugggccuucgacucggggaacgaccucuggaugggccggaccaucgagaaggagucccgcagcggguacgagaccuuccgggucaucggcggguggaacacggccaacuccaagucgcagaccucgcgccaggugaucguggacuccgacaacagcuccggcuacucgggcaucuucuccgucgagggcaagagcugcaucaaccggugcuucuacguggagcugauccgcgggcgccccaaggagacccgggucugguggaccuccaacucgaucaucguguucugcgggacguccggcaccuacgggaccggcagcuggccggacggcgcgaacaucaacuucauggccaucuga

SEQ ID NO: 25934 - RNA, 1410 nt, Artificial Sequence
  derived and/or modified CDS sequence (AUadapt) from InfluenzaA__AGQ81738__NA
augaaucccaaccagaagaucaucgccaucggcucggugucccugaccaucgccaccaucugccuccugaugcaggucgcgauccuggugacgaccaugacccuccacuucaagcacaacgagugcucgaacuccagcaacaaccaggccgugccgugcgggcccaucaucaucgagcgcaacaucaccgagaucguccaccugaacuccacgacccuggagaaggagaucugccccaaggccgccggcuaccgggacuggucgaagccccagugccagaucaccggguucgccccguucuccaaggacaacagcauccgccucuccgcgucgggcgacaucugggugacccgggagcccuacguguccugcgggcugggcaagugcuaccaguucgcccugggccaggggacgacccucgacaaccgccacagcaacggcaccucccacgaccggacgccccaccgcacccugcugaugaacgagcucgggguccccuuccaccuggccaccaagcaggucuguaucgccuggucguccucguccugccacgacggcaaggcguggcugcacgugugcgugaccggggacgaccggaacgccaccgccagcaucaucuacgacggcauccucguggacuccaucggcucguggagcaagaacauccugcgcacgcaggaguccgagugcgugugcaucaacgggaccugcaccgucgugaugaccgacggcucggccuccgggaaggccgacacgcggauccuguucauccgcgagggcaagaucauccacaucagcccgcucuccggcucggcgcagcacguggaggagugcuccugcuacccccaguaccccgagguccggugcgugugccgcgacaacuggcgggggucgaaccgccccgugcuguacaucaacauggccgacuacuccaucgacagcggcuacgucuguuccgggcuggugggcgacaccccgcggaacgacgacaucucguccagcuccaacugcaaggaccccaacaacgagcgcggggcccccggcgugaagggcugggccuucgacucggggaacgaccucuggaugggccggaccaucgagaaggagucccgcagcggguacgagaccuuccgggucaucggcggguggaacacggccaacuccaagucgcagaccucgcgccaggugaucguggacuccgacaacagcuccggcuacucgggcaucuucuccgucgagggcaagagcugcaucaaccggugcuucuacguggagcugauccgcgggcgccccaaggagacccgggucugguggaccuccaacucgaucaucguguucugcgggacguccggcaccuacgggaccggcagcuggccggacggcgcgaacaucaacuucaugcccaucuga

SEQ ID NO: 25935 - RNA, 1410 nt, Artificial Sequence
  derived and/or modified CDS sequence (AUadapt) from InfluenzaA__AGQ81739__NA
augaaccccaaccagaagaucaucgccaucggcucggugucccugaccaucgccaccaucugccuccugaugcagaucgcgauccuggucacgaccaugacccuccacuucaagcacgacgagugcaccaacucguccaacaaccaggccgugccgugcgagcccaucaucaucgagcgcaacgugacggagaucguccacaucaacagcaccauccuggagaaggagaucugccccaaggccgccggguaccggaacugguccaagccccagugccagaucaccggcuucgccccguucucgaaggacaacuccauccgccugucggcguccggggacaucugggugacccgggagcccuacgugagcugcggccucgggaagugcuaccaguucgcccugggccagggcacgacccuggacaaccgccacuccaacgggacccucaacgaccggacgccccaccgcacccugcugaugaacgagcucggcguccccuuccaccuggccaccaagcaggucugcaucgccuggucguccucguccugccacgacgggaaggcguggcugcacgugugcgugaccggcgacgaccggaacgccaccgccagcaucaucuacgacgacaugcucguggacuccaucgggucgugguccaagaacauccugcgcacgcaggagucggagugcgugugcaucaacgggaccugcaccgucgugaugaccgacggcagcgccuccggcaaggccgacacgcggauccuguucauccgcgagggcaagaucgugcacaucucgccgcucuccgggucggcgcagcacgucgaggagugcuccugcuacccccaguaccccgaggugcggugcgugugccgcgacaacuggcggggcagcaaccgccccguccuguacaucaacauggccgacuacuccaucgacucgggcuacgugugcuccgggcuggugggcgacaccccgcggaacgacgacaucucguccagcuccaacugcaaggaccccaacaacgagcgcggggcccccggcgucaaggggugggccuucgacucgggcaacgacaucuggaugggccggaccaucgagaaggacucccgcucgggguacgagaccuuccgggugaucggcggguggaacacggccaacuccaagagccagaccucccgccaggugaucgucgacucggacaacucguccggcuacagcgggaucuucuccguggagggcaagucgugcaucaaccggugcuucuacgucgagcucauccgcggccgccccaaggagacccgggugugguggaccuccaacucgaucaucguguucugcgggacguccggcaccuacgggaccggcagcuggccggacggggcgaacaucaacuucauggccaucuga

SEQ ID NO: 25936 - RNA, 1410 nt, Artificial Sequence
  derived and/or modified CDS sequence (AUadapt) from InfluenzaA__AGQ81740__NA
augaaucccaaccagaagaucguggccaucggcucggucucccugaccaucgccaccaucugccuccugaugcagaucgcgauccuggugacgaccaugacccuccacuucaagcacggggagugcaccaacucguccaacaaccaggccgugccgugcggccccaucaucaucgagcgcaacaucacggagaucguccaccugaacagcaccacccuggagaaggagaucugccccaaggccgccggguaccgggacugguccaagccccagugccagaucaccggcuucgccccguucaguaaggacaacuccauccgccucagcgcguccggggacaucugggugacgcgggagcccuacgugucgugcggccugggcaagugcuaccaguucgcccuggggcagggcaccacccucgacaaccgccacuccaacgggaccagccacgaccggacgccccaccgcacccugcugaugaacgagcucggcguccccuuccaccuggccaccaagcaggucugcaucgccugguccaguuccagcugccacgacgggaaggcguggcugcacgugugcgugaccggcgacgaccggaacgccacggccuccaucaucuacaacggcauccucguggacucgaucggguccuggagcaagaacauccugcgcacccaggagucggagugcgugugcaucaacgggaccugcaccgucgugaugacggacggcuccgccagcggcaaggccgauacccggauccuguucauccgcgagggcaagaucgugcacaucuccccgcucucgggguccgcgcagcacgucgaggagugcagcugcuacccccaguaccccgaggugcggugcgugugccgcgacaacuggcggggcuccaaccgccccguccuguacaucaacauggccgacuacucgguggacuccggguacgugugcaguggccuggucggggacaccccgcggaacgacgacaccuccucguccagcaacugcaaggaccccaacaacgagcgcggcgcccccggcgugaaggggugggccuucgacuccggcaacgacaucuggauggggcggacgaucgagaaggaccuccgcucgggcuacgagaccuuccgggugaucgggggcuggaacaccgccaacuccaagagccagaccucccgccaggucaucguggauucggacaacagcuccggcuacucggggaucuucuccgucgagggcaagagcugcaucaaccggugcuucuacguggagcugauccgcgggcgccccaaggagacgcgggugugguggaccuccaacucgaucaucgucuucugcggcaccuccgggaccuacggcacgggcagcuggccggacggggcgaacaucaacuucaugcccaucuga

SEQ ID NO: 25937 - RNA, 1410 nt, Artificial Sequence
  derived and/or modified CDS sequence (AUadapt) from InfluenzaA__AGQ81741__NA
augaaucccaaccagaagaucguggccaucggcucggucucccugaccaucgccaccaucugccuccugaugcagaucgcgauccuggugacgaccaugacccuccacuucaagcacggggagugcaccaacagcuccaacaaccaggccgugccgugcggccccaucaucaucgagcgcaacaucacggagaucguccaccugaacucgaccacccuggacaaggagaucugccccaaggccgccggguaccgggauugguccaagccccagugccagaucaccggcuucgccccguucagcaaggacaacuccauccgccucucggcguccggggacaucugggugacgcgggagcccuacgugagcugcggccugggcaagugcuaccaguucgcccuggggcagggcaccacccucgacaaccgccacuccaacgggaccucgcaugaccggacgccccaccgcacccugcugaugaacgagcucggcguccccuuccaccuggccaccaagcaggucugcaucgccugguccagcuccucgugccacgacgggaaggcguggcugcacgugugcgugaccggcgacgaccggaacgccacggccuccaucaucuacgacggcaugcucguggacaguaucggguccuggucgaagaacauccugcgcacccaggagagcgagugcgugugcaucaacgggaccugcaccgucgugaugacggacggcuccgccucgggcaaggccgacacccggauccuguucauccgcgagggcaagaucgugcacaucuccccgcucagcggguccgcgcagcacgucgaggagugcucgugcuacccccaguaccccgaggugcggugugugugccgcgacaacuggcggggcuccaaccgccccguccuguacaucaacauggccgacuacagcguggacuccggguacgugugcucgggccuggucggggacaccccgcggaacgacgacaccuccagcuccucgaauugcaaggaccccaacaacgagcgcggcgcccccggcgugaaggggugggccuucgacuccggcaacgacaucuggauggggcggacgaucgagaaggaccuccgcagcggcuacgagaccuuccgggugaucgggggcuggaacaccgccaacuccaagucgcagaccucccgccaggucaucguggacagcgacaacaguuccggcuacagcgggaucuucuccgucgagggcaagucgugcaucaaccggugcuucuacguggagcugauccgcgggcgccccaaggagacgcgggugugguggaccuccaacagcaucaucgucuucugcggcaccuccgggaccuacggcacgggcagcuggccggacggggcgaacaucaacuucaugcccaucuga

SEQ ID NO: 25938 - RNA, 1410 nt, Artificial Sequence
  derived and/or modified CDS sequence (AUadapt) from InfluenzaA__AGQ81742__NA
augaaucccaaccagaagaucguggccaucggcucggucucccugaccaucgccaccaucugccuccugaugcagaucgcgauccuggugacgaccaugacccuccacuucaagcacggggagugcaccaacucguccaacaaccaggccgugccgugcggccccaucaucaucgagcgcaacaucacggagaucguccaccugaacagcaccacccuggagaaggagaucugccccaaggccgccgaguaccgggacugguccaagccccagugccagaucaccggguucgccccguucaguaaggacaacuccauccgccucagcgcguccggcgacaucugggugacgcgggagcccuacgugucgugcgggcugggcaagugcuaccaguucgcccugggccaggggaccacccucgacaaccgccacuccaacggcaccagccacgaccggacgccccaccgcacccugcugaugaacgagcucgggguccccuuccaccuggccaccaagcaggucugcaucgccugguccaguuccagcugccacgacggcaaggcguggcugcacgugugcgugaccggggacgaccggaacgccacggccuccaucaucuacgacggcaugcucguggacucgaucggcuccuggagcaagaacauccugcgcacccaggagucggagugcgugugcaucaacgggaccugcaccgucgugaugacggacggcuccgccagcgggaaggccgauacccggauccuguucauccgcgagggcaagaucgugcacaucuccccgcucucgggcuccgcgcagcacgucgaggagugcagcugcuacccccaguaccccgaggugcggugcgugugccgcgacaacuggcggggguccaaccgccccguccuguacaucaacauggccgacuacucgguggacuccggcuacgugugcagugggcuggucggcgacaccccgcggaacgacgacaccuccucguccagcaacugcaaggaccccaacaacgagcgcggggcccccggcgugaagggcugggccuucgacuccgggaacgacaucuggaugggccggacgaucgagaaggaccuccgcucgggguacgagaccuuccgggugaucggcggguggaacaccgccaacuccaagagccagaccucccgccaggucaucguggauucggacaacagcuccggcuacucgggcaucuucuccgucgagggcaagagcugcaucaaccggugcuucuacguggagcugauccgcgggcgccccaaggagacgcgggugugguggaccuccaacucgaucaucgucuucugcgggaccuccggcaccuacgggacgggcagcuggccggacggcgcgaacaucaacuucaugcccaucuga

SEQ ID NO: 25939 - RNA, 1410 nt, Artificial Sequence
  derived and/or modified CDS sequence (AUadapt) from InfluenzaA__AGQ81744__NA
augaaucccaaccagaagaucaucgccaucggcucggugucccugaccaucgccaccaucugccuccugaugcagaucgcgauccuggucacgaccaugacccuccacuuccgccacgacgagugcaccaacagcuccaacaaccaggccgugccgugcgggcccaucaucaucgagcggaacgugacggagaucguccaccugaacaguaccacccuggagaaggagaucugccccaaggccgccgaguaccgcgacugguccaagccccagugccagaucaccggcuucgugccguucagcaaggacaacuccauccggcucucggccgggggcgacaucugggugacgcgcgagcccuacgucuccugcgggcugggcaagugcuaccaguucgcgcugggccaggggaccacccucgauaaccggcacagcaacggcaccucccacgaccgcacgccccaccggacccugcugaugaacgagcucggggugcccuuccaccuggccaccaagcaggucugcaucgccuggagcuccucguccugccacgacggcaaggccuggcugcacgugugugugaccggggacgaccgcaacgcgacggccagcaucaucuacgacggcaugcucguggacuccaucggcucgugguccaagaacauccugcggacccaggagagcgagugcgucugcaucaacgggaccugcaccguggugaugacggacggcucggccuccgggaaggccgauacccgcauccuguucauccgggagggcaagaucguccacaucagcccgcucuccggcagcgcccagcacguggaggagugcuccugcuacccccaguaccccgaggugcgcugcgucugccgggacaacuggcgcgggucgaaccggcccgugcuguacaucaauguggcggacuacuccgucgacagcggcuacgugugcuccgggcuggugggcgacaccccgcgcaacgacgacaucucguccagcuccaacugcaaggaccccaacaacgagcgcggggcccccggcgucaagggcugggccuuugacucggggaacgacaucuggaugggccggaccaucgagaaggacucccggagcggguacgagacguuccgcgugaucggcggguggaacaccgccaacuccaagagccagaccucccggcaggucaucguggacucggacaaccccagcggcuauuccggcaucuucucgguggaggggaaguccugcaucaaccgcugcuucuacgucgagcucauccgcggccggccgaaggagacccgcgugugguggacgagcaacuccaucaucguguucugcgggaccagcggcaccuacgggaccggcuccuggcccgacggcgccaacaucaacuucaugcccaucuga

SEQ ID NO: 25940 - RNA, 1410 nt, Artificial Sequence
  derived and/or modified CDS sequence (AUadapt) from InfluenzaA__AGQ81746__NA
augaaucccaaccagaagaucaucgccaucggcucggugucccugaccaucgccaccaucugccuccugaugcagaucgcgauccuggucacgaccaugacccuccacuucaagcacaacgagugcagcaacuccucgaacucccaggccgugccgugcgggcccaucaucaucgagcgcaacgugaccgagaucguccaccugaacagcacgacccuggagaaggagaucugccccaaggccgccgaguaccggggcugguccaagccccagugccagaucaccggguucgccccguucucgaaggacaacuccauccgccucagcgcguccggcgacaucugggugacccgggagcccuacgugucgugcgaccuggggaagugcuaccaguucgcccugggccagggcacgacccucgauaaccgccacuccaacgggaccagccacgaccggacgccccaccgcacccugcugaugaacgagcucggcguccccuuccaccuggccaccaagcaggucugcaucgccugguccucguccagcugccacgacgggaaggcguggcugcacgugugcgugaccggcgacgaccggaacgccaccgccuccaucaucuacgacgggauccucguggacucgaucggcagcugguccaagaacauccugcgcacgcaggagucggagugcgugugcaucaacgggaccugcaccgucgugaugaccgacggcuccgccagcggcaaggccgauacgcggauccuguucauccgcgaggggaagaucgugcacaucuccccgcucucgggcuccgcgcagcacgucgaggagugcagcugcuacccccaguaccccgaggugcggugcgugugccgcgacaacuggcggggcuccaaccgccccguccuguacaucaacauggccgacuacucgaucgacuccggguacgugugcagcggccuggugggggacaccccgcggaacgacgacaucuccucguccagcaacugcaaggaccccaacaacgagcgcggcgcccccggggucaagggcugggccuuugacuccggcaacgaccucuggauggggcggaccaucgagaaggacucgcgcuccggcuacgagaccuuccgggugaucgggggcuggaacacggccaacagcaagucgcagaccucccgccaggugaucgucgacagcgacaacuccucgggguacuccggcaucuucagcguggagggcaaguccugcaucaaccggugcuucuacgucgagcugauccgcgggcgccccaaggagacccgggugugguggaccucgaacuccaucaucguguucugcggcacgagcgggaccuacggcaccggguccuggccggacggcgcgaacaucaacuucaugcccaucuga

SEQ ID NO: 25941 - RNA, 1410 nt, Artificial Sequence
  derived and/or modified CDS sequence (AUadapt) from InfluenzaA__AGQ81747__NA
augaaucccaaccagaagaucguggccaucggcucggucucccugaccaucgccaccaucugccuccugaugcagaucgcgauccuggugacgaccaugacccuccacuucaagcacggggagugcaccaacagcuccaacaaccaggccgugccgugcggccccaucaucaucgagcgcaacaucacggagaucguccaccugaacucgaccacccuggagaaggagaucugccccaaggccgccggguaccgggauugguccaagccccagugccagaucaccggcuucgccccguucagcaaggacaacuccauccgccucucggcguccggggacaucugggugacgcgggagcccuacgugagcugcggccugggcaagugcuaccaguucgcccuggggcagggcaccacccucgacaaccgccacuccaacgggaccucgcaugaccggacgccccaccgcacccugcugaugaacgagcucggcguccccuuccaccuggccaccaagcaggucugcaucgccugguccagcuccucgugccacgacgggaaggcguggcugcacgugugcgugaccggcgacgaccggaacgccacggccuccaucaucuacgacggcaugcucguggacaguaucggguccuggucgaagaacauccugcgcacccaggagagcgagugcgugugcaucaacgggaccugcaccgucgugaugacggacggcuccgccucgggcaaggccgacacccggauccuguucauccgcgagggcaagaucgugcacaucuccccgcucagcggguccgcgcagcacgucgaggagugcucgugcuacccccaguaccccgaggugcggugugugugccgcgacaacuggcggggcuccaaccgccccguccuguacaucaacauggccgacuacagcguggacuccggguacgugugcucgggccuggucggggacaccccgcggaacgacgacaccuccagcuccucgaauugcaaggaccccaacaacgagcgcggcgcccccggcgugaaggggugggccuucgacuccggcaacgacaucuggauggggcggacgaucgagaaggaccuccgcagcggcuacgagaccuuccgggugaucgggggcuggaacaccgccaacuccaagucgcagaccucccgccaggucaucguggacagcgacaacaguuccggcuacagcgggaucuucuccgucgagggcaagucgugcaucaaccggugcuucuacguggagcugauccgcgggcgccccaaggagacgcgggugugguggaccuccaacagcaucaucgucuucugcggcaccuccgggaccuacggcacgggcagcuggccggacggggcgaacaucaacuucaugcccaucuga

SEQ ID NO: 25942 - RNA, 1401 nt, Artificial Sequence
  derived and/or modified CDS sequence (AUadapt) from InfluenzaA__AGQ81749__NA
augaaccccaaccagaagaucaucgccaucggcucggugucccugaccaccgccaucaucugcuuccucaugcagaucgcgauccugacgaccaccaugacccugcacuucaagcagaacgagugcucgaacccguccaacaaccaggucgugcccugcgagcccaucaucaucgagcgcaacacggugcaccucaacucgaccaccaucgagaaggagaucugcuccaaggucgccgaguacaagaacuggagcaagccccagugccagaucaccggguucgccccguucuccaaggacaacucgauccggcuguccgccggcggggacaucugggugacgcgcgagcccuacgugucgugcucccugggcaagugcuaccaguucgcccucgggcagggcaccacccugaagaacaagcacucgaacggcaccacgcacgaccggaucccccaccgcacccugcucaugaacgagcuggggguccccuuccaccugggcaccaagcaggucugcaucgcgugguccagcuccucgugcuacgacgggaaggccuggcuccacaucugcgugaccggcgacgacaagaacgccacggccuccaucaucuacgacgggaugcuggcggacucgaucggcuccuggucgaagaacauccugcggacccaggagagcgagugcgugugcaucaacgggaccugcgccguggugaugaccgacggguccgccucgggcaaggccgacacgcgcauccucuucauccgggaggggcgcaucaucaacaucuccccgcugucgggcuccgcccagcacgucgaggagugcagcugcuacccccgguaccccgaggugcgcugcgugugccgggacaacuggaagggcuccaaccgccccguccuguacaucaacauggcggacuacucgguggaguccucguacgugugcuccgggcucgucggcgacaccccgcggaacgacgacucguccagcuccucgaacugccgcgaccccaacaacgagcggggcgcccccggcgugaaggggugggccuucgacgacggcaacgacguguggaugggccgcaccaucaagaaggacucccggucgggguacgagaccuuccgcgucaucaacggcuggacgaccgccaacuccaagucgcagaucaaccgccaggugaucguggacagcgacaacugguccggguacucgggcaucuucuccgucgaggggaagaacugcaucaaccggugcuucuacguggagcugauccggggccgcccccaggagccgaaggucugguggaccucgaacuccaucaucgccuucugcggcaccagcgggacguacggcaccggguccuggcccgacggcgcgaacaucaacuucaugcccaucuga

SEQ ID NO: 25943 - RNA, 1401 nt, Artificial Sequence; identical to SEQ ID NO: 25942
  derived and/or modified CDS sequence (AUadapt) from InfluenzaA__AGQ81750__NA

SEQ ID NO: 25944 - RNA, 1410 nt, Artificial Sequence
  derived and/or modified CDS sequence (AUadapt) from InfluenzaA__AGQ81751__NA
augaaucccaaccagaagaucaucgccaucggcucggugucccugaccaucgccaccaucugccuccugaugcagaucgcgauccuggucacgaccaugacccucuacuucaagcacaacgagugcucgaacuccagcaacaaccaggccgugccgugcgggcccaucaucaucgagcgcaacaucaccgagaucgugcaccugaacuccacgacccuggagaaggagaucugccccaaggccgccggcuaccgggacuggucgaagccccagugccagaucaccggguucgccccguucuccaaggacaacagcauccgccucuccgcgucgggcgacaucugggucacccgggagcccuacguguccugcgggcugggcaagugcuaccaguucgcccugggccaggggacgacccucgacaaccgccacagcaacggcaccucccacgaccggacgccccaccgcacccugcugaugaacgagcucggggugcccuuccaccuggccaccaagcaggucugcaucgccuggucguccucguccugccacgacggcaaggcguggcugcacgugugcgugaccggggacgaccggaacgccaccgccagcaucaucuacgacggcauccucgucgacuccaucggcucguggagcaagaacauccugcgcacgcaggaguccgagugcgugugcaucaacgggaccugcaccguggucaugaccgacggcucggccuccgggaaggccgauacgcggauccuguucauccgcgagggcaagaucgugcacaucagcccgcucuccggcucggcgcagcacguggaggagugcuccugcuacccccaguaccccgagguccggugcgugugccgcgacaacuggcgggggucgaaccgccccgugcuguacaucaacauggccgacuacuccaucgacagcggcuacgucugcuccgggcuggugggcgacaccccgcggaacgacgacaucucguccagcuccaacugcaaggaccccaacaacgagcgcggggcccccggcgugaagggcugggccuucgacucggggaacgaccucuggaugggccggaccaucgagaaggagucccgcagcggguacgagaccuuccgggucaucggcggguggaacacggccaacuccaagucgcagaccucgcgccaggugaucguggacuccgacaacagcuccggcuacucgggcaucuucuccgucgagggcaagagcugcaucaaccggugcuucuacguggagcugauccgcgggcgccccaaggagacccgggucugguggaccuccaacucgaucaucguguucugcgggacguccggcaccuacgggaccggcagcuggccggacggcgcgaacaucaacuucaugcccaucuga

SEQ ID NO: 25945 - RNA, 1410 nt, Artificial Sequence
  derived and/or modified CDS sequence (AUadapt) from InfluenzaA__AGQ81753__NA
augaaucccaaccagaagaucguggccaucggcucggucucccugaccaucgccaccaucugccuccugaugcagaucgcgauccuggugacgaccaugacccuccacuucaagcacggggagugcaccaacucguccaacaaccaggccgugccgugcggccccaucaucaucgagcgcaacaucacggggaucguccaccugaacagcaccacccuggagaaggagaucugccccaaggccgccggcuaccgggacugguccaagccccagugccagaucaccggguucgccccguucaguaaggacaacuccauccgccucagcgcguccggcgacaucugggugacgcgggagcccuacgugucgugcggccuggggaagugcuaccaguucgcccugggccaggggaccacccucgacaaccgccacuccaacggcaccagccacgaccggacgccccaccgcacccugcugaugaacgagcucgggguccccuuccaccuggccaccaagcaggucugcaucgccugguccaguuccagcugccacgacggcaaggcguggcugcacaucugcgugaccggcgacgaccggaacgccacggccuccaucaucuacgacgggaugcucguggacucgaucggcuccuggagcaagaacauccugcgcacccaggagucggagugcgugugcaucaacgggaccugcaccguggucaugacggacggcuccgccagcggcaaggccgauacccggauccuguucauccgcgaggggaagaucgugcacaucuccccgcucucgggcuccgcgcagcacguggaggagugcucgugcuacccccaguaccccgagguccggugcgugugccgcgacaacuggcggggguccaaccgccccgugcuguacaucaacauggccgacuacagcgucgacuccggcuacgugugcagugggcuggugggcgacaccccgcggaacgacgacaccuccagcuccucgaacugcaaggaccccaacaacgagcgcggcgcccccggggucaagggcugggccuucgacuccgggaacgacaucuggaugggccggacgaucgagaaggaccuccgcagcggguacgagaccuuccgggugaucggcggcuggaacaccgccaacuccaagucgcagaccaaucgccaggugaucgucgacuccgacaacagcucgggguacuccggcaucuucagcguggaggggaaguccugcaucaaccggugcuucuacgucgagcugauccgcggccgccccaaggagacgcgggugugguggaccucgaacuccaucaucguguucugcgggaccagcggcaccuacggcacgggguccuggccggacggcgcgaacaucaacuucaugcccaucuga

SEQ ID NO: 25946 - RNA, 1410 nt, Artificial Sequence; identical to SEQ ID NO: 25945
  derived and/or modified CDS sequence (AUadapt) from InfluenzaA__AGQ81754__NA

SEQ ID NO: 25947 - RNA, 1410 nt, Artificial Sequence
  derived and/or modified CDS sequence (AUadapt) from InfluenzaA__AGQ81756__NA
augaaucccaaccagaagaucaucgccaucggcucgaucucccugaccaucgccaccaucugccuccugauccagaucgcgauccuggugacgaccaugacccuccacuucaagcacggggagugcaccaacucguccaacaaccaggccgucccgugcggccccaucaucaucgagcgcaacgugacggagaucgugcaccugaacagcaccacccuggagaaggagaucugccccaaggccgccggguaccgggacugguccaagccccagugccagaucaccggcuucgccccguucaguaaggacaacuccauccgccucagcgcguccggggacaucugggucacgcgggagcccuacgugucgugcggccugggcaagugcuaccaguucgcccuggggcagggcaccacccucgacaaccgccacuccaacgggaccagccacgaccggacgccccaccgcacccugcugaugaacgagcucggcgugcccuuccaccuggccaccaagcaggucugcaucgccugguccaguuccagcugccacgacgggaaggcguggcugcacgugugcgugaccggcgacgaccggaacgccacggccuccaucaucuacgacggccuccuggucgacucgaucggguccuggagcaagaacauccugcgcacccaggagucggagugcgugugcaucaacgggaccugcaccguggucaugacggacggcuccgccagcggcaaggccgauacccggauccucuucauccgcgagggcaagaucauccacaucuccccgcugucgggguccgcgcagcacguggaggagugcagcugcuacccccaguaccccgaggugcggugcgucugccgcgacaacuggcggggcuccaaccgccccgugcuguacaucaacauggccgacuacucgguggacuccggguacgucugcaguggccucgugggggacaccccgcggaacgacgacaccuccucguccagcaacugcaaggaccccaacaacgagcgcggcgcccccggcgugaaggggugggccuucgacuccggcaacgacaucuggauggggcggacgaucgagaaggacucgcgcuccggcuacgagaccuuccgggucaucgggggcuggaacaccgccaacagcaagucccagaccagucgccaggugaucguggacagcgacaacuccucgggcuacuccgggaucuucagcgucgagggcaaguccugcaucaaccggugcuucuacguggagcugauccgcgggcgccccaaggagacgcgggucugguggaccucgaacuccaucaucguguucugcggcaccagcgggaccuacggcacgggcuccuggccggacggggcgaacaucaacuucaugcccaucuga

SEQ ID NO: 25948 - RNA, 1410 nt, Artificial Sequence
  derived and/or modified CDS sequence (AUadapt) from InfluenzaA__AGQ81757__NA
augaaucccaaccagaagaucaucgccaucggcucggugucccugaccaucgccaccaucugccuccugauccagaucgcgauccuggucacgaccaugacccuccacuucaagcacggggagugcaccaacagcuccaacaaccaggccgugccgugcggccccaucaucaucgagcgcaacgugacggagaucguccaccugaacucgaccacccuggagaaggagaucugccccaaggccgccggguaccgggauugguccaagccccagugccagaucaccggcuucgccccguucagcaaggacaacuccauccgccucucggcguccggggacaucugggugacgcgggagcccuacgugagcugcggccugggcaagugcuaccaguucgcccuggggcagggcaccacccucgacaaccgccacuccaacgggaccucgcaugaccggacgccccaccgcacccugcugaugaacgagcucggcguccccuuccaccuggccaccaagcaggucugcaucgccugguccagcuccucgugccacgacgggaaggcguggcugcacgugugcgugaccggcgacgaccggaacgccacggccuccaucaucuacgacggccuccugguggacaguaucggguccuggucgaagaacauccugcgcacccaggagagcgagugcgugugcaucaacgggaccugcaccgucgugaugacggacggcuccgccucgggcaaggccgacacccggauccucuucauccgcgagggcaagaucauccacaucuccccgcugagcggguccgcgcagcacguggaggagugcucgugcuacccccaguaccccgagguccggugugugugccgcgacaacuggcggggcuccaaccgccccgugcuguacaucaacauggccgacuacagcgucgacuccggguacgugugcucgggccucgugggggacaccccgcggaacgacgacaccuccagcuccucgaauugcaaggaccccaacaacgagcgcggcgcccccggcgucaaggggugggccuucgacuccggcaacgacaucuggauggggcggacgaucgagaaggacagccgcuccggcuacgagaccuuccgggugaucgggggcuggaacaccgccaacucgaagucccagaccagccgccaggugaucgucgacucggacaauuccagcggcuacuccgggaucuucucgguggagggcaaguccugcaucaaccggugcuucuacgucgagcugauccgcgggcgccccaaggagacgcgggugugguggaccagcaacuccaucaucguguucugcggcaccagcgggaccuacggcacgggcuccuggccggacggggcgaacaucaacuucaugcccaucuga

SEQ ID NO: 25949 - RNA, 1401 nt, Artificial Sequence
  derived and/or modified CDS sequence (AUadapt) from InfluenzaA__AGQ81758__NA
augaaccccaaccagaagaucaucgccaucggcucggugucccugaucaucgccaucaucugccuccugaugcagaucgcgauccugaccaccacgaugacccuccacuuccgccagaacgagugcucgaacccguccaacaaccaggucgugcccugcgagcccaccaucaucgagcggaacaccgugcaccugaacucgacgaccaucgagcgcgagaucugccccaaggucgccgaguacaagaacugguccaagccgcagugccagaucaccggguucgcccccuucagcaaggacaacuccauccggcugucggccggcggggacaucugggugacccgcgagcccuacguguccugcucgcucggcaagugcuaccaguucgcccuggggcagggcacgacccugaagaacaagcacuccaacggcaccacccacgaccggacgccccaccgcacccuccugaugaacgagcugggggucccguuccaccucggcaccaagcaggucugcaucgcguggagcuccucguccugcuacgacgggaaggccuggcugcacaucugcgugaccggcgacgacgagaacgccacggccucgaucaucuacgacgggaugcugguggacuccaucggcagcugguccaagaacauccuccggacccaggagucggagugcgugugcaucaacgggaccugcgcgguggucaugaccgacggcucggccuccggcaaggccgacacgcgcgugcuguucauccgggaggggaagaucaucaacaucagcccccuguccggcucggcccagcacguggaggagugcuccugcuacccccgcuaccccgagguccggugcgugugccgcgacaacuggaagggcucgaaccggccggugcucuacaucaacauggccgacuacuccaucgagucguccuacgucugcagcgggcuggugggcgacacgccccgcaacgacgacuccucguccucguccaacugccgggaccccaacaacgagcgcggggcgcccggcgugaaggggugggccuucgacgacggcaacgacgucuggaugggccggaccaucaagaacgacagccgcuccggguacgagaccuuccggguggugaacggcuggaccauggccaacucgaagucccagaucaaccgccaggucaucguggacucggacaacuggagcggguacuccggcaucuucucggucgaggggaagaagugcaucaaccggugcuucuacguggagcugauccgcggccgcccgcaggagccccgggugugguggaccuccaacucgaucaucgucuucugcggcaccuccgggaccuacggcacggggagcuggcccgacggcgccaacaucaacuucaugcccaucuga

SEQ ID NO: 25950 - RNA, 1401 nt, Artificial Sequence
  derived and/or modified CDS sequence (AUadapt) from InfluenzaA__AGQ81759__NA
augaaccccaaccagaagaucaucgccaucggcucggugucccugaccaucgccaucaucugcuuccucauccagaucgcgauccugaccacgaccaugacccugcacuuccgccagucggagugcuccaacccgagcaacaaccaggucgugcccugcgagcccaucaucaucgagcggaacaccgugcaccucaacuccacgaucaucgagaaggagaucugccccaaggucgccgaguacaagaacuggucgaagccgcagugccagaucaccggguucgcccccuucuccaaggacaacagcauccgccuguccgccggcggggacaucugggugacccgggagcccuacgugucgugcucccugggcaagugcuaccaguucgcccucgggcagggcaccacgcugaagaacaagcacagcaacggcaccacccacgaccgcaucccccaccggacccugcucaugaacgagcugggggucccguuccaccugggcacgaagcaggucugcaucgcgugguccucguccagcugccacgacgggaaggccuggcuccacaucugcgugaccggcgacgacaagaacgccaccgccuccaucaucuacgacgggaugcugguggacucgaucggcuccuggucgaagaacauccugcgcacccaggagagcgagugcgugugcaucaacggcacgugcgcgguggucaugaccgacggguccgccucgggcaaggccgacacccggauccucuucauccgcgaggggaagaucaucaacaucagcccccuguccggcuccgcccagcacguggaggagugcucgugcuacccccgguaccccgaggugcgcugcgucugccgggacaacuggaagggcuccaaccgcccggugcuguacaucaacauggccgacuacagcaucgaguccucguacgugugcuccgggcucgucggcgacacgccccgggacgacgacagcuccucguccucgaacugccgcgaccccaacaacgagcgcggggcgcccggcgugaaggggugggccuucgacgacggcaacgacaucuggaugggccggaccaucaaguccgacagccgguccggguacgagaccuuccgcgugaucaacggcuggaccaccgccaacucgaagagccagaucaaccggcaggucaucguggacuccgacucgugguccggguacagcggcaucuucuccguggaggggaagaacugcaucaaccgcugcuucuacgucgagcugauccggggccgcccgcgcgagacgcgggugugguggaccucgaacuccaucaucgucuucugcggcaccagcgggaccuacggcacgggguccuggcccgacggcgccaacaucaacuucaugcccaucuga

SEQ ID NO: 25951 - RNA, 1401 nt, Artificial Sequence
  derived and/or modified CDS sequence (AUadapt) from InfluenzaA__AGQ81760__NA
augaaccccaaccagaagaucaucgccaucggcucggugucccugaccaucgccaucaucugcuuccucaugcagaucgcgauccugaccacgaccaugacccugcacuuccgccagaacgagugcucgaacccguccaacaaccaggucgugcccugcgagcccaucaucaucgagcggaacaccgugcaccucaacagcacgaccaucgagaaggagaucugccccaaggucgccgaguacaagaacugguccaagccgcagugccagaucaccggguucgcccccuucucgaaggacaacuccauccgccugagcgccggcggggacaucugggugacccgggagcccuacguguccugcucgcugggcaagugcuaccaguucgcccucgggcagggcacgacccugaagaacaagcacuccaacggcaccacccacgaccgcaucccccaccggacgcugcucaugaacgagcugggggucccguuccaccugggcaccaagcaggucugcaucgcguggucguccagcuccugccacgacgggaaggccuggcuccacaucugcgugaccggcgacgacaagaacgccaccgccucgaucaucuacgacgggaugcugguggacuccaucggcagcugguccaagaacauccugcgcacgcaggagucggagugcgugugcaucaacgggaccugcgcgguggucaugaccgacgggucggccuccggcaaggccgacacccggguccucuucauccgcgaggggaagaucaucaacaucagcccccuguccggcucggcccagcacguggaggagugcuccugcuacccccgguaccccgaggugcgcugcgugugccgggacaacuggaagggcagcaaccgcccggugcuguacaucaacauggccgacuacuccaucgagucguccuacgucugcucggggcucgugggcgacacgccccgggacgacgacuccagcuccucguccaacugccgcgaccccaacaacgagcggggcgcgcccggcgugaaggggugggccuucgacgacggcaacgacaucuggaugggccgcaccaucaagagcgacucccggucgggguacgagaccuuccgcgucgugaacggcuggaucaccgccaacuccaagucgcagaucaaccgccaggugaucgucgacagcgacuccuggucgggguacuccggcaucuucagcguggaggggaagaacugcaucaaccggugcuucuacgucgagcugauccggggccgcccgcaggagacgcgcgugugguggaccuccaacucgaucaucguguucugcggcaccuccgggaccuacggcacggggagcuggcccgacggcgccaacaucaacuucaugcccaucuga

SEQ ID NO: 25952 - RNA, 1401 nt, Artificial Sequence
  derived and/or modified CDS sequence (AUadapt) from InfluenzaA__AGQ81761__NA
augaaccccaaccagaagaucaucgccaucggcucggugucccugaccaucgccaucaucugcuuccucaugcagaucgcgauccugaccacgaccaugacccugcacuuccgccagaacgagugcucgaacccguccaacaaccaggucgugcccugcgagcccaucaucaucgagcggaacaccgugcaccucaacagcacgaccaucgagaaggagaucugccccaaggucgccgaguacaagaacugguccaagccgcagugccagaucaccggguucgcccccuucucgaaggacaacuccauccgccugucggccggcggggacaucugggugacccgggagcccuacguguccugcagccugggcaagugcuaccaguucgcccucgggcagggcacgacccugaagaacaagcacuccaacggcaccacccacgaccgcaucccccaccggacgcugcucaugaacgagcugggggucccguuccaccugggcaccaagcaggucugcaucgcguggucguccucguccugccacgacgggaaggccuggcuccacaucugcgugaccggcgacgacaagaacgccaccgccagcaucaucuacgacgggaugcugguggacuccaucggcucgugguccaagaacauccugcgcacgcaggagagcgagugcgugugcaucaacgggaccugcgcgguggucaugaccgacggcucggccuccggcaaggccgacacccggauccucuucaucaaggaggggaagaucaucaacaucucgccccuguccggcagcgcccagcacguggaggagugcuccugcuacccccgcuaccccgaggugcggugcgucugccgcgacaacuggaagggcucgaaccggccggugcuguacaucaacauggccgacuacuccaucgagucguccuacgugugcagcgggcucgucggcgacacgccccgcgacgacgacuccucguccagcuccaacugccgggaccccaacaacgagcgcggggcgcccggcgugaaggggugggccuucgacgacggcaacgacaucuggaugggccggaccaucaagucggacucccgcucgggguacgagaccuuccggguggucaacggcuggaccacggccaacuccaagagccagaucaaccgccaggugaucguggacucggacuccuggucgggguacuccggcaucuucagcgucgaggggaagaacugcaucaaccggugcuucuacguggagcugauccgcggccggccgcaggagacccgcgucugguggaccuccaacucgaucaucguguucugcggcaccuccgggacguacggcaccgggagcuggcccgacggcgccaacaucaacuucaugcccaucuga

SEQ ID NO: 25953 - RNA, 1401 nt, Artificial Sequence
  derived and/or modified CDS sequence (AUadapt) from InfluenzaA__AGQ81763__NA
augaaccccaaccagaagaucaucgccaucggcucggugucccugaucaucgccaucaucugccuccugaugcagaucgcgauccugaccaccacgaugacccuccacuuccgccagaacgagugcucgaacccguccaacaaccaggucgugcccugcgagcccaucaucaucgagcggaacaccgugcaccugaacagcaccacgaucgagcgcgagaucugccccaaggucgccgaguacaagaacugguccaagccgcagugccagaucaccggguucgcccccuucucgaaggacaacuccauccggcugucggccggcggggacaucugggugacccgcgagcccuacguguccugcagccucggcaagugcuaccaguucgcccuggggcagggcaccacgcugaagaacaagcacuccaacggcaccacccacgaccggacgccccaccgcacccuccugaugaacgagcugggggucccguuccaccucggcaccaagcaggucugcaucgcguggucguccucguccugcuacgacgggaaggccuggcugcacaucugcgugaccggcgacgacaagaacgccaccgccagcaucaucuacgacgggaugcugguggacuccaucggcucgugguccaagaacauccuccggacgcaggagucggagugcgugugcaucaacgggaccugcgcgguggucaugaccgacggcagcgccuccggcaaggccgacacccgcgugcuguucauccgggaggggaagaucaucaacaucucgccccuguccggcucggcccagcacguggaggagugcuccugcuacccccgcuaccccgagguccggugcgugugccgcgacaacuggaagggcagcaaccggccggugcucuacaucaacauggccgacuacuccaucgagucguccuacgucugcucggggcuggugggcgacacgccccgcaacgacgacuccagcuccucguccaacugccgggaccccaacaacgagcgcggggcgcccggcgugaaggggugggccuucgacgacggcaacgacgucuggaugggccggaccaucaagaacgggucgcgcuccggcuacgagaccuuccggguggugaacggguggaccauggccaacagcaagucccagaucaaccgccaggucaucguggacucggacaacuggucgggcuacuccgggaucuucagcgucgagggcaagaagugcaucaaccggugcuucuacguggagcugauccgcggccgcccgcaggagccccgggugugguggacguccaacucgaucaucgucuucugcgggaccuccggcaccuacgggaccggcagcuggcccgacggggccaacaucaacuucaugcccaucuga

SEQ ID NO: 25954 - RNA, 1401 nt, Artificial Sequence
  derived and/or modified CDS sequence (AUadapt) from InfluenzaA__AGQ81766__NA
augaaccccaaccagaagaucaucgccaucggcucggugucccugaccaucgccaucaucugcuuccucaugcagaucgcgauccugaccacgaccaugacccugcacuuccgccagaacgagugcucgaacccguccaacaaccaggucgugcccugcgagcccaucaucaucgagcggaacaccgugcaccucaacagcacgaccaucgagaaggagaucugccccaaggucgccgaguacaagaacugguccaagccgcagugccagaucaccggguucgcccccuucucgaaggacaacuccauccgccugagcgccggcggggacaucugggugacccgggagcccuacguguccugcucgcugggcaagugcuaccaguucgcccucgggcagggcacgacccugaagaacaagcacuccaacggcaccacccacgaccgcaucccccaccggacgcugcucaugaacgagcugggggucccguuccaccugggcaccaagcaggucugcaucgcguggagcuccucguccugccacgacgggaaggccuggcuccacaucugcgugaccggcgacgacaagaacgccaccgccagcaucaucuacgacgggaugcugguggacuccaucggcucgugguccaagaacauccugcgcacgcaggagagcgagugcgugugcaucaacgggaccugcgcgguggucaugaccgacgggucggccuccggcaaggccgacacccggauccucuucauccgcgaggggaagaucaucaacaucagcccccuguccggcucggcccagcacguggaggagugcuccugcuacccccgguaccccgaggugcgcugcgucugccgggacaacuggaagggcucgaaccgcccggugcuguacaucaacauggccgacuacuccaucgagagcuccuacgugugcucggggcucgucggcgacacgccccgggacgacgacuccuucagcuccucgaacugccgcgaccccaacaacgagcggggcgcgcccggcgugaaggggugggccuucgacgacggcaacgacaucuggaugggccgcaccaucaaguccgacagccgguccggguacgagaccuuccgcguggucaacggcuggaccacggccaacucgaagucccagaucaaccgccaggugaucguggacagcgacucgugguccggguacagcggcaucuucuccgucgaggggaagaacugcaucaaccggugcuucuacguggagcugauccggggccgcccgcaggagaccaucgucugguggaccucgaacuccaucaucguguucugcggcaccagcgggacguacggcaccggguccuggcccgacggcgccaacaucaacuucaugcccaucuga

SEQ ID NO: 25955 - RNA, 1401 nt, Artificial Sequence; identical to SEQ ID NO: 25954
  derived and/or modified CDS sequence (AUadapt) from InfluenzaA__AGQ81767__NA

SEQ ID NO: 25956 - RNA, 1410 nt, Artificial Sequence
  derived and/or modified CDS sequence (AUadapt) from InfluenzaA__AGQ81768__NA
augaaucccaaccagaagaucguggccaucggcucggucucccugaccaucgccaccaucugccuccugaugcagaucgcgauccuggugacgaccaugacccuccacuucaagcacggggagugcaccaacagcuccaacaaccaggccgugccgugcggccccaucaucaucgagcgcaacaucacggagaucguccaccugaacucgaccacccuggagaaggagaucugccccaaggccgccggguaccgggauugguccaagccccagugccagaucaccggcuucgccccguucagcaaggacaacuccauccgccucucggcguccggggacaucugggugacgcgggagcccuacgugagcugcggccugggcaagugcuaccaguucgcccuggggcagggcaccacccucgacaaccgccacuccaacgggaccucgcaugaccggacgccccaccgcacccugcugauguccgagcucggcguccccuuccaccuggccaccaagcaggucugcaucgccuggagcuccucguccugccacgacggggaggcguggcugcacaucugcgugaccggcgacgaccggaacgccacggccagcaucaucuacgacggcaugcucguggacuccaucgggaguuggagcaagaacauccugcgcacccaggaguccgagugcgugugcaucaacgggaccugcaccguggucaugacggacggcucggccuccggcaaggccgacacccggauccuguucauccgcgagggcaagaucgugcacaucagcccgcucuccgggucggcgcagcacguggaggagugcuccugcuacccccaguaccccgagguccggugcgugugucgcgacaacuggcggggcagcaaccgccccgugcuguacaucaacauggccgacuacuccgucgacucgggguacgugugcuccggccuggugggggacaccccgcggaacgacgacaccagcuccucguccaacuguaaggaccccaacaacgagcgcggcgcccccggcgucaaggggugggccuucgacagcggcaacgacaucuggauggggcggacgaucgagaaggaccuccgcuccggcuacgagaccuuccgggugaucgggggcuggaacaccgccaacucgaagucccagaccaaccgccaggugaucgucgacagcgacaacaguuccggcuacagcgggaucuucuccguggagggcaagucgugcaucaaccggugcuucuacgucgagcugauccgcgggcgccccaaggagacgcgggugugguggaccuccaacagcaucaucguguucugcggcaccuccgggaccuacggcacgggcagcuggccggacggggcgaacaucaacuucaugcccaucuga

SEQ ID NO: 25957 - RNA, 1410 nt, Artificial Sequence
  derived and/or modified CDS sequence (AUadapt) from InfluenzaA__AGQ81769__NA
augaaucccaaccagaagaucguggccaucggcucggucucccugaccaucgccaccaucugccuccugaugcagaucgcgauccuggugacgaccaugacccuccacuucaagcacggggagugcaccaacagcuccaacaaccaggccgugccgugcggccccaucaucaucgagcgcaacaucacggagaucguccaccugaacucgaccacccuggagaaggagaucugucccaaggccgccggguaccgggacugguccaagccccagugccagaucaccggcuucgccccguucagcaaggacaacuccauccgccucucggcguccggggacaucugggugacgcgggagcccuacgugagcugcggccugggcaagugcuaccaguucgcccuggggcagggcaccacccucgauaaccgccacuccaacgggaccucgcacgaccggacgccccaccgcacccugcugauguccgagcucggcguccccuuccaccuggccaccaagcaggucugcaucgccuggagcuccagcuccugccacgacggggaggcguggcugcacaucugugugaccggcgacgaccggaacgccacggccucgaucaucuacggcgggaugcucguggacuccaucggcagcuggucgaagaacauccugcgcacccaggaguccgagugcgugugcaucaacgggaccugcaccguggucaugacggacggcagcgccuccggcaaggccgacacccggauccuguucauccgcgaggggaagaucgugcauaucucgccgcucuccggcagcgcgcagcacguggaggagugcuccugcuacccccaguaccccgagguccggugcgugugccgcgacaacuggcgggggucgaaccgccccgugcuguacaucaacauggccgacuauuccgucgacagcggcuacgugugcuccgggcuggugggcgacaccccgcggaacgacgacaccagcuccucguccaacugcaaggaccccaacaacgagcgcggcgcccccggggucaagggcugggccuucgauagcgggaacgacaucuggaugggccggacgaucgagaaggaccuccgcuccggguacgagaccuuccgggugaucggcggcuggaacaccgccaacucgaagucccagaccaaccgccaggugaucgucgacagcgacaacucguccggguacaguggcaucuucuccguggagggcaagucgugcaucaaccggugcuucuacgucgagcugauccgcgggcgccccaaggagacgcgggugugguggaccuccaacagcaucaucguguucugcgggaccuccggcaccuacggcacggggagcuggccggacggcgcgaacaucaacuucaugcccaucuga

SEQ ID NO: 25958 - RNA, 1401 nt, Artificial Sequence
  derived and/or modified CDS sequence (AUadapt) from InfluenzaA__AGQ81770__NA
augaaccccaaccagaagaucaucgccaucggcucgguguccaucaccaucgccaucaucugcuucaucaugcagaucgcgauccugaccacgaccaugacccuccacuuccgccagaacgagugcucgaacccguccaacaaccaggucgugcccugcgagcccaucaucaucgagcggaacaccgugcaccugaacagcacgaccaucgagaaggagaccugccccaaggucgccgaguacaagaacugguccaagccgcagugccagaucaccggguucgcccccuucucgaaggacaacuccauccgccugucggccggcggggacaucugggugacgcgggagcccuacguguccugcagccucggcaagugcuaccaguucgcccuggggcagggcaccacccugaagaacaagcacuccaacggcaccacgcacgaccgcaucccccaccggacccuccugaugaacgagcugggggucccguuccaccucggcaccaagcaggucugcaucgcguggucguccucguccugccacgacgggaaggccuggcugcacaucugcgugaccggcgacgacaagaacgccacggccagcaucaucuacgacgggaugcugguggacuccaucggcucgugguccaagaacauccuccgcacccaggagucggagugcgugugcaucaacgggaccugcgcgguggucaugaccgacgggagcgccuccggcaaggccgacacgcgggugcuguucauccgcgaggggaagaucaucaacaucucgccccuguccggcucggcccagcacguggaggagugcuccugcuacccccgguaccccgagguccgcugcgugugccgggacaacuggaagggcagcaaccgcccggugcucuacaucaacauggccgacuacuccgucgagucguccuacgugugcucggggcuggugggcgacacgccccgggacgacgacuccagcuccucguccaacugccgcgaccccaacaacgagcggggcgcgcccggcgucaaggggugggccuucgacgacggcaacgacaucuggaugggccgcaccaucaagucggacucccggagcggguacgagaccuuccgcguggugaacggcuggaccaccgccaacuccaagucgcagaucaaccggcaggucaucguggacucggacuccuggagcggguacuccggcaucuucucggucgaggggaagaacugcaucaaccgcugcuucuacguggagcugauccggggccgcccgcaggagacccgcgugugguggaccuccaacucgaucaucgucuucugcggcacguccgggaccuacggcaccgggagcuggcccgacggcgccaacaucaacuucaugcccaucuga

SEQ ID NO: 25959 - RNA, 1410 nt, Artificial Sequence
  derived and/or modified CDS sequence (AUadapt) from InfluenzaA__AGQ81772__NA
augaaucccaaccagaagaucguggccaucggcucggccucccugaccaucgcgaccaugugccuccugcugcagaucgcccucuucgccacgaccaugacccugcacuucaagcagaccgggugcacgaacagcuccgacaaccaggccgucccguguggccccaucaucaucgagcgcaacaucaccgagaucgugcaccugaacucgaccacccucgagaaggagacgugccccaaguccgccggguaccggaacuggagcaagccccagugccagaucaccggcuucgcgccguucuccaaggacaauucgauccgccuggccgccgccggggacaucugggugacccgggagcccuacgucuccugcggccugggcaagugcuaccaguucgcgcucgggcagggcaccacgcuggacaacaagcacagcaaugggaccacccacgaccgcacgccccaccggacccugcucauguccgagcugggcgugcccuuccaccuggccaccaagcaggucugcaucgccuggagcuccucguccugccacgacgggaaggccuggcuccacgugugugugaccggcgacgacaagaacgccaccgcgagcaucaucuacgacggcauccugguggacuccaucgccucgugguccaagaacauccugcgcacgcaggagagcgagugcgucuguaucaacgggaccugcaccguggugaugaccgacggcagcgccuccgggcgggccgacacgcgcauccucuucauccgggagggcaagaucguccacaucucgccgcuguccggcagcgcccagcacguggaggagugcuccugcuauccccgcuaccccgaggugcggugcgucugccgcgacaacuggaaggggucgaaccggcccgugcuguucaucaacauggcggacuacuccaucgauagcuccuacgugugcccgggccucgucggggacacgccccgcaacgacgaccggagcuccucguccaacugccgcgaccccaauaacgagcggggcgcccccggggugaagggcugggccuucgacagcggcaacgacaucuggauggggcgcaccaucgagaaggacucccggucgggcuacgagaccuuccgcgugaucuccggguggagcaccgccaauuccaagagccagaucaaccggcaggucaucguggaccgcgacaacucguccggcuacagcgggaucuucuccguggagggcaagucgugcaucaaccgcuguuucuacgucgagcugauccggggccgcccgaaggagaaccgggugugguggaccuccaacagcaucaucgucuucugcgggaccuccggcaccuacgggacgggcagcuggcccgacggggccaacaucaaccugaugcccaucuga

SEQ ID NO: 25960 - RNA, 1401 nt, Artificial Sequence
  derived and/or modified CDS sequence (AUadapt) from InfluenzaA__AGQ81773__NA
augaaccccaaccagaagaucaucgccaucggcucggugucccugaccaucgccaucaucugcuuccucaugcagaucgcgauccugaccacgaccaugacccugcacuuccgccagaacgagugcucgaacccguccaacaaccaggucgugcccugcgagcccaucaucaucgagcggaagaccgugcaccucaacagcacgaccaucgagaaggagaucugccccaaggucgccgaguacaagaacugguccaagccgcagugccagaucaccggguucgcccccuucucgaaggacaacuccauccgccugucggccggcggggacaucugggugacccgggagcccuacguguccugcagccugggcaagugcuaccaguucgcccucgggcagggcacgacccugaagaacaagcacuccaacggcaccacccacgaccgcaucccccaccggacgcugcucaugaacgagcugggggucccgcugcacuggggcaccaagcaggucugcaucgcguggucguccucguccugccacgacgggaaggccuggcuccacaucugcgugaccggcgacgacaagaacgccaccgccagcaucaucuacgacgggaugcugguggacuccaucggcucgugguccaagaacauccugcgcacgcaggagucggagugcgugugcaucaacgggaccugcgcgguggucaugaccgacgggagcgccuccggcaaggccgacacccggguccucuucauccgcgaggggaagaucaucaacaucucgccccuguccggcucggcccagcacguggaggagugcuccugcuacccccgguaccccgaggugcgcugcgugugccgggacaacuggaagggcagcaaccgcccggugcuguacaucaacauggccgacuacuccaucgagucguccuacgucugcucggggcucgugggcgacacgccccgggacgacgacuccagcuccucguccaacugccgcgaccccaacaacgagcggggcgcgcccggcgugaagggguggggcuucgacgacggcaacgacaucuggauggggcgcaccaucaagucggacucccggagcggcuacgagaccuuccgcgucgugaacggguggaccacggccaacuccaagucgcagaucaaccgccaggugaucgucgacucggacuccuggagcggcuacuccgggaucuucucgguggagggcaagaacugcaucaaccggugcuucuacgucgagcugauccggggccgcccgcaggagacccgcgugugguggaccuccaacucgaucaucguguucugcgggaccuccggcacguacgggaccggcagcuggcccgacggggccaacaucaacuucaugcccaucuga

SEQ ID NO: 25961 - RNA, 1401 nt, Artificial Sequence
  derived and/or modified CDS sequence (AUadapt) from InfluenzaA__AGQ81774__NA
augaaccccaaccagaagaucaucgccaucggcucggugucccugaucaucgccaucaucugccuccugaugcagaucgcgauccugaccaccacgaugacccuccacuuccgccagaacgagugcucgaacccguccaacaaccaggucaugcccugcgagcccaucaucaucgagcggaacaccgugcaccugaacagcaccacgaucgagcgcgagaucugccccaagguggccgaguacaagaacugguccaagccgcagugccagaucaccggguucgcccccuucucgaaggacaacuccauccggcugucggccggcggggacaucugggucacccgcgagcccuacguguccugcagccucgacaagugcuaccaguucgcccugggccaggggaccacgcugaagaacaagcacuccaacggcaccacccacgaccggacgccccaccgcacccuccugaugaacgagcugggcgugccguuccaccucgggaccaagcaggucugcaucgcguggucguccucguccugcuacgacggcaaggccuggcugcacaucugcgugaccggggacgacaagaacgccaccgccagcaucaucuacgacggcaugcugguggacuccaucgggucgugguccaagaacauccuccggacgcaggagucggagugcgucugcaucaacgggaccugcgcgguggugaugaccgacggcagcgccuccggcaaggccgacacccgcguccuguucauccgggagggcaagaucaucaacaucucgccccuguccgggucggcccagcacguggaggagugcuccugcuacccccgcuaccccgaggugcggugcgucugccgcgacaacuggaagggcagcaaccggccgauccucuacaucaacauggccgacuacuccaucgagucguccuacgugugcucgggccuggugggggacacgccccgcaacgacgacuccagcuccucguccaacugccgggaccccaacaacgagcgcggcgcgcccggggucaagggcugggccuucgacgacgggaacgacguguggaugggccggaccaucaagaacggcucgcgcuccggguacgagaccuuccggguggucaacggcuggaccaucgccaacagcaagucccagaucaaccgccaggugaucguggacucggacgacuggucgggguacuccggcaucuucagcgucgaggggaagaagugcaucaaccggugcuucuacguggagcugauccgcggccgcccgcaggagccccgggucugguggacguccaacucgaucaucguguucugcggcaccuccgggaccuacggcaccgggagcuggcccgacggcgccaacaucaacuucaugcccaucuga

SEQ ID NO: 25962 - RNA, 1401 nt, Artificial Sequence
  derived and/or modified CDS sequence (AUadapt) from InfluenzaA__AGQ81776__NA
augaaccccaaccagaagaucaucgccaucggcucggugucccugaccaucgccaucaucugcuuccucaugcagaucgcgauccugaccacgaccaugacccugcacuuccgccagaacgagugcucgaacccguccaacaaccaggucgugcccugcgagcccaucaucaucgagcggaacaccgugcaccucaacagcacgaccaucgagaaggagaucugccccaaggucgccgaguacaagaacugguccaagccgcagugccagaucaccggguucgcccccuucucgaaggacaacuccauccgccugucggccggcggggacaucugggugacccgggagcccuacguguccugcagccugggcaagugcuaccaguucgcccucgggcagggcacgacccugaagaacaagcacuccaacggcaccacccacgaccgcaucccccaccggacgcugcucaugaacgagcugggggucccguuccaccugggcaccaagcaggucugcaucgcguggucguccucguccugccacgacgggaaggccuggcuccacaucugcgugaccggcgacgacaagaacgccaccgccagcaucaucuacgacgggaugcugguggacuccaucggcucgugguccaagaacauccugcgcacgcaggagagcgagugcgugugcaucaacgggaccugcgcgguggucaugaccgacgggucggccuccggcaaggccgacacccggguccucuucauccgcgaggggaagaucaucaacaucucgccccuguccggcagcgcccagcacguggaggagugcuccugcuacccccgguaccccgaggugcgcugcgugugccgggacaacuggaagggcucgaaccgcccggugcuguacaucaacauggccgacuacuccaucgagucguccuacgucugcagcgggcucgugggcgacacgccccgggacgacgacuccucguccagcuccaacugccgcgaccccaacaacgagcggggcgcgcccggcgugaaggggugggccuucgacgacggcaacgacaucuggaugggccgcaccaucaagucggacucccggucgggguacgagaccuuccgcgucaucgacggcuggaccacggccgacuccaagagccagaucaaccgccaggugaucguggacucggacuccuggucgggguacuccggcaucuucagcgucgaggggaagaacugcaucaaccggugcuucuacguggagcugauccggggccgcccgcaggagacccgcgucugguggaccuccaacucgaucaucguguucugcggcaccuccgggacguacggcaccgggagcuggcccgacggcgccaacaucaacuucaugcccaucuga

SEQ ID NO: 25963 - RNA, 1410 nt, Artificial Sequence
  derived and/or modified CDS sequence (AUadapt) from InfluenzaA__AGQ81777__NA
augaaucccaaccagaagaucgugaccaucggcucggccucccugaccaucgccacgaugugccuccugcugcagaucgcccucuucgcgaccaccaugacccugcacuucaagcagacggggugcaccaacucguccgacaaccaggccgucccgugcggccccaucaucaucgagcgcaacaucaccgagaucgugcaccugaacagcaccacgcucgagaaggagaccugucccaaguccgccggguaccggaacuggucgaagccccagugccagaucaccggcuucgccccguucuccaaggacaacagcauccgccuggcggccgccggggacaucugggugacccgggagcccuacgucuccugcggccugggcaagugcuaccaguucgcccucgggcagggcacgacccuggacaacaagcauucgaacgggaccacccacgaccgcacgccccaccggacccugcucaugaacgagcugggcgugcccuuccaccuggcgaccaagcaggucugcaucgccugguccagcuccucgugccacgacgggaaggccuggcuccacgugugcgugaccggcgaugacaagaacgccacggccuccaucaucuacgacggcauccugguggacagcaucgcguccuggucgaagaacauccugcgcacccaggaguccgagugcgucugcaucaacgggaccugcaccguggugaugacggacggcagcgccucggggcgggccgacacccgcauccucuucauccgggagggcaagaucguccauaucuccccgcugagcggcuccgcccagcacguggaggagugcucgugcuacccccgcuaccccgaggugcggugcgucugccgcgacaacuggaacggguccaaccggcccgugcuguucaucaacauggccgacuauagcaucgacuccucguacgugugcuccggccucgucggggacaccccgcgcaacgacgaccggagcuccucguccaacugccgcgaccccaacaacgagcggggcgcgcccggggugaagggcugggccuucgauagcggcaacgacaucuggauggggcgcaccaucgagaaggacucccggucgggcuacgagacguuccgcgugaucuccggguggagcaccgccaacuccaagucgcagaucaaccggcaggucaucguggaccgcgacaacagcuccggcuacagugggaucuucuccguggagggcaagagcugcaucaaccgcugcuucuacgucgagcugauccggggccgccccaaggagaaccgggugugguggaccuccaacucgaucaucgucuucugcgggaccuccggcacguacgggaccggcagcuggccggacggggccaacaucaaccugaugcccaucuga

SEQ ID NO: 25964 - RNA, 1410 nt, Artificial Sequence
  derived and/or modified CDS sequence (AUadapt) from InfluenzaA__AGQ81778__NA
augaaucccaaccagaagaucgugaccaucggcucggccucccugaccaucgccacgaugugccuccugcugcagaucgcccucuucgcgaccaccaugacccugcacuucaagcagacggggugcaccaacucguccgacaaccaggccgucccgugcggccccaucaucaucgagcgcaacaucaccgagaucgugcaccugaacagcaccacgcucgagaaggagaccugucccaaguccgccggguaccggaacuggucgaagccccagugccagaucaccggcuucgccccguucuccaaggacaacagcauccgccuggcggccgccggggacaucugggugacccgggagcccuacgucuccugcggccugggcaagugcuaccaguucgcccucgggcagggcacgacccuggacaauaagcacucgaacgggaccacccacgaccgcacgccccaccggacccugcucaugaacgagcugggcgugcccuuccaccuggcgaccaagcaggucugcaucgccugguccagcuccucgugccacgacgggaaggccuggcuccacgugugcgugaccggcgaugacaagaacgccacggccuccaucaucuacgacggcauccugguggacagcaucgcguccuggucgaagaacauccugcgcacccaggaguccgagugcgucugcaucaacgggaccugcaccguggugaugacggacggcagcgccucggggcgggccgacacccgcauccucuuuauccgggagggcaagaucguccacaucuccccgcugagcggcuccgcccagcacguggaggagugcucgugcuacccccgcuaccccgaggugcggugcgucugccgcgacaacuggaagggguccaaccggcccgugcuguucaucaacauggccgacuauagcaucgacuccucguacgugugcuccggccucgucggggacaccccgcgcaacgacgaccggagcuccucguccaacugccgcgaccccaacaacgagcggggcgcgcccggggugaagggcugggccuucgauagcggcaacgacaucuggauggggcgcaccaucgagaaggacucccggucgggcuacgagacguuccgcgugaucuccggguggagcaccgccaacuccaagucgcagaucaaccggcaggucaucguggaccgcgacaacagcuccggcuacagugggaucuucuccguggagggcaagagcugcaucaaccgcugcuucuacgucgagcugauccggggccgccccaaggagaaccgggugugguggaccuccaacucgaucaucgucuucugcgggaccuccggcacguacgggaccggcagcuggccggacggggccaacaucaaccugaugcccaucuga

SEQ ID NO: 25965 - RNA, 1410 nt, Artificial Sequence
  derived and/or modified CDS sequence (AUadapt) from InfluenzaA__AGQ81779__NA
augaaucccaaccagaagaucguggccaucggcucggccucccugaccaucgcgaccaugugccuccugcugcagaucgcccucuucgccacgaccaugacccugcacuucaagcagaccgggugcacgaacucguccgacaaccaggccgucccgugcggccccaucaucaucgagcgcaacaucaccgagaucgugcaccugaacagcaccacccucgagaaggagacgugucccaaguccgccggguaccggaacuggucgaagccccagugccagaucaccggcuucgcgccguucuccaaggacaacagcauccgccuggccgccgccggggacaucugggugacccgggagcccuacgucuccugcggccugggcaagugcuaccaguucgcgcucgggcagggcaccacgcuggacaauaagcacucgaacgggaccacccacgaccgcacgccccaccggacccugcucaugaacgagcugggcgugcccuuccaccuggccaccaagcaggucugcaucgccugguccagcuccucgugccacgacgggaaggccuggcuccacgugugcgugaccggcgaugacaagaacgccaccgcguccaucaucuacgacggcauccugguggacagcaucgccuccuggucgaagaacauccugcgcacgcaggaguccgagugcgucugcaucaacgggaccugcaccguggugaugaccgacggcagcgccucggggcgggccgacacgcgcauccucuuuauccgggagggcaagaucguccacaucuccccgcugagcggcuccgcccagcacguggaggagugcucgugcuacccccgcuaccccgagauccggugcgugugccgcgacaacuggaagggguccaaccggcccguccuguucaucaacauggcggacuauagcaucgacuccucguacgugugcuccggccucgugggggacaccccgcgcaacgacgaccggagcuccucguccaacugccgcgaccccaacaacgagcggggcgcccccggggucaagggcugggccuucgauagcggcaacgacaucuggauggggcgcaccaucgagaaggacucccggucgggcuacgagaccuuccgcgugaucuccggguggagcacggccaacuccaagucgcagaucaaccgccaggugaucgucgaccgggacaacagcuccggcuacagugggaucuucuccguggagggcaagagcugcaucaaccgcugcuucuacguggagcugauccggggccgccccaaggagaaccgggucugguggaccuccaacucgaucaucguguucugcgggaccuccggcaccuacgggacgggcagcuggccggacggggccaacaucaaccugaugcccaucuga

SEQ ID NO: 25966 - RNA, 1410 nt, Artificial Sequence
  derived and/or modified CDS sequence (AUadapt) from InfluenzaA__AGQ81780__NA
augaaucccaaccagaagaucguggccaucggcucggccucccugaccaucgcgaccaugugccuccugcugcagaucgcccucuucgccacgaccaugacccugcacuucaagcagaccgggugcacgaacagcuccgacaaccaggccgucccgugcggccccaucaucaucgagcgcaacaucaccgagaucgugcaccugaacucgaccacccucgagaaggagacgugucccaaguccgccggguaccggaacuggagcaagccccagugccagaucaccggcuucgcgccguucuccaaggacaacucgauccgccuggccgccgccggggacaucugggugacccgggagcccuacgucuccugcggccugggcaagugcuaccaguucgcgcucgggcagggcaccacgcuggacaauaagcacagcaacgggaccacccacgaccgcacgccccaccggacccugcucaugaacgagcugggcgugcccuuccaccuggccaccaagcaggucugcaucgccugguccucguccagcugccacgacgggaaggccuggcuccacgugugcgugaccggcgaugacaagaacgccaccgcguccaucaucuacgacggcauccugguggacucgaucgccuccuggagcaagaacauccugcgcacgcaggaguccgagugcgucugcaucaacgggaccugcaccguggugaugaccgacggcucggccagcgggcgggccgacacgcgcauccucuuuauccgggagggcaagaucguccacaucuccccgcugucgggcuccgcccagcacguggaggagugcagcugcuacccccgcuaccccgaggugcggugcgucugccgcgacaacuggaagggguccaaccggcccgugcuguucaucaacauggcggacuauucgaucgacuccagcuacgugugcuccggccucgucggggacaccccgcgcaacgacgaccggucguccagcuccaacugccgcgaccccaacaacgagcggggcgccucgggggugaagggcugggccuuugacuccggcaacgacaucuggauggggcgcaccaucgagaaggacagccgguccggcuacgagaccuuccgcgugaucucggggugguccacggccaacagcaagucgcagaucaaccggcaggucaucguggaccgcgacaacuccagcggcuauuccgggaucuucucgguggagggcaaguccugcaucaaccgcugcuucuacgucgagcugauccggggccgccccaaggagaaccgggugugguggaccagcaacuccaucaucgucuucugcgggaccagcggcaccuacgggacgggcuccuggcccgacggggccaacaucaaccugaugccgaucuga

SEQ ID NO: 25967 - RNA, 1401 nt, Artificial Sequence
  derived and/or modified CDS sequence (AUadapt) from InfluenzaA__AGQ81781__NA
augaaccccaaccagaagaucaucgccaucggcucggugucccugaccaucgccaucaucugcuuccucaugcagaucgcgauccugaccacgaccaugaccccgcacuuccgccagaacgagugcucgaaccccuccaacaaccaggucgugcccugcgagcccaucaucaucgagcggaacaccgugcaccugaacucgacgaccaucgagaaggagaucugcccgaaggucgccgaguacaagaacugguccaagccccagugccagaucaccggguucgcccccuucagcaaggacaacuccauccgccucucggccggcggggacaucugggugacccgggagcccuacguguccugcucgcugggcaagugcuaccaguucgcccuggggcagggcacgacccucaagaacaagcacuccaacggcaccacccacgaccgcaucccgcaccggacgcugcugaugaacgagcucgggguccccuuccaccugggcaccaagcaggucugcaucgcguggagcuccucguccugccacgacgggaaggccuggcugcacaucugcgugaccggcgacgacaagaacgccaccgccucgaucaucuacgacgggaugcucguggacuccaucggcucgugguccaagaacauccugcgcacgcaggagagcgagugcgugugcaucaacgggaccugcgcgguggucaugaccgacgggucggccuccggcaaggccgacacccggauccuguucauccgcgaggggaagaucaucaacaucucgccccucuccggcagcgcccagcacguggaggagugcuccugcuacccccgguacccggaggugcgcugcgucugccgggacaacuggaagggcucgaaccgccccgugcuguacaucaacauggccgacuacuccaucgagucguccuacgugugcagcgggcuggucggcgacacgccccgggacgacgacuccucguccucguccaacugccgcgaccccaacaacgagcggggcgcgccgggcgugaaggggugggccuucgacgacggcaacgacaucuggaugggccgcaccaucaagucggacucccggagcggguacgagaccuuccgcguggucaacggcuggaccacggccaacuccaagucgcagaucaaccgccaggugaucguggacucggacuccuggagcggguacuccggcaucuucucggucgaggggaagaacugcaucaaccggugcuucuacguggagcucauccggggccgcccccaggagacccgcgucugguggaccuccaacucgaucaucguguucugcggcaccuccgggacguacggcaccgggagcuggcccgacggcgccgacaucaaccugaugcccaucuga

SEQ ID NO: 25968 - RNA, 1410 nt, Artificial Sequence
  derived and/or modified CDS sequence (AUadapt) from InfluenzaA__AGQ81783__NA
augaaucccaaccagaagaucgugaccaucggcucggccucccugaccaucgccacgaugugccuccugcugcagaucgcccucuucgcgaccaccaugacccugcacuucaagcagacggggugcaccaacucguccgacaaccaggccgucccgugcggccccaucaucaucgagcgcaacaucaccgagaucgugcaccugaacagcaccacgcucgagaaggagaccugccccaaguccgccggguaccggaauuggucgaagccccagugccagaucaccggcuucgccccguucuccaaggacaacagcauccgccuggcggccgccggggacaucugggugacccgggagcccuacgucuccugcggccugggcaagugcuaccaguucgcccucgggcagggcacgacccuggacaacaagcacucgaacgggaccacccacgaucgcacgccccaccggacccugcucaugaacgagcugggcgugcccuuccaccuggcgaccaagcaggucugcaucgccugguccagcuccucgugccacgacgggaaggccuggcuccacgugugcgugaccggcgacgacaagaacgccacggccuccaucaucuacaacggcauccugguggacagcaucgcguccuggaguaagaacauccugcgcacccaggaguccgagugcgucugcaucaacgggaccugcaccguggugaugacggacggcucggccagcgggcgggccgacacccgcauccucuucauccgggagggcaagaucguccacaucuccccgcugucgggcuccgcccagcacguggaggagugcagcugcuacccccgcuaccccgaggugcggugcgucugucgcgacaacuggaagggguccaaccggcccgugcuguucaucaacauggccgacuacucgaucgacuccagcuacgugugcuccggccucgucggggacaccccgcgcaacgacgaccggucguccagcuccaacugucgcgaccccaacaacgagcggggcgcgcccggggugaagggcugggccuucgacucgggcaacgacaucuggauggggcgcaccaucgagaaggacucccggucgggcuacgagacguuccgcgugaucuccggguggagcaccgccaacuccaagucgcagaucaaccggcaggucaucguggaccgcgacaacaguuccggcuacucggggaucuucuccguggagggcaagagcugcaucaaccgcugcuucuacgucgagcugauccggggccgccccaaggagaaccgggugugguggaccuccaacucgaucaucgucuucugcgggaccuccggcacguacgggaccggcagcuggccggacggggccaacaucaaccugaugcccaucuga

SEQ ID NO: 25969 - RNA, 1401 nt, Artificial Sequence
  derived and/or modified CDS sequence (AUadapt) from InfluenzaA__AGQ81784__NA
augaaccccaaccagaagaucaucgccaucggcucggugucccugaccaucgccaucaucugcuuccucaugcagaucgcgauccugaccacgaccaugacccugcacuuccgccagaacgagugcucgaacccguccaacaaccaggucgugcccugcgagcccaucaucaucgagcggaacaccgugcaccucaacagcacgaccaucgagaaggagaucugccccaaggucgccgaguacaagaacugguccaagccgcagugccagaucaccggguucgcccccuucucgaaggacaacuccauccgccugucggccggcggggacaucugggugacccgggagcccuacguguccugcagccugggcaagugcuaccaguucgcccucgggcagggcacgacccugcgcaacaagcacuccaacggcaccacccacgaccggaucccccaccgcacgcugcucaugaacgagcugggggucccguuccaccugggcaccaagcaggucugcaucgcguggucguccucguccugccacgacgggaaggccuggcuccacaucugcgugaccggcgacgacaagaacgccaccgccagcaucaucuacgacgggaugcugguggacuccaucggcucgugguccaagaacauccugcggacgcaggagucggagugcgugugcaucaacgggaccugcgcgguggucaugaccgacggcaacgccagcggcaaggccgacacccgcguccucuucauccgggaggggaagaucaucaacaucucgccccuguccggcuccgcccagcacguggaggagugcucgugcuacccccgcuaccccgaggugcggugcgugugccgcgacaacuggaagggcuccaaccggccggugcuguacaucaacauggccgacuacagcaucgaguccucguacgucugcuccgggcucgugggcgacacgccccgcgacgacgacucguccagcuccucgaacugccgggaccccaacaacgagcgcggggcgcccggcgugaaggggugggccuucgacgacggcaacgacaucuggaugggccggaccaucaaguccgacucgcgcuccggguacgagaccuuccgggucgugaacggcuggaccacggccaacagcaagucccagaucaaccgccaggugaucgucgacucggacucgugguccggguacagcggcaucuucuccguggaggggaagaacugcaucaaccggugcuucuacgucgagcugauccgcggccgcccgcaggagacccgggugugguggaccucgaacuccaucaucguguucugcggcaccagcgggacguacggcaccggguccuggcccgacggcgccgacaucaacuucaugcccaucuga

SEQ ID NO: 25970 - RNA, 1401 nt, Artificial Sequence
  derived and/or modified CDS sequence (AUadapt) from InfluenzaA__AGQ81785__NA
augaaccccaaccagaagaucaucgccaucggcucggugucccugaccaucgccaucaucugcuucaucaugcagaucgcgauccucaccacgaccaugaccccgcacuuccgccagaacgagugcucgaaccccuccaacaaccaggucgugcccugcgagcccaucaucaucgagcggaacaccgugcaccugaacucgacgaccaucgagaaggagaucugcccgaaggucgccgaguacaagaacugguccaagccccagugccagaucaccggguucgcccccuucagcaaggacaacuccauccgccugucggccggcggggacaucugggugacccgggagcccuacguguccugcucgcucggcaagugcuaccaguucgcccuggggcagggcacgacccugaagaacaagcacuccaacggcaccacccacgaccgcaucccgcaccggacgcuccugaugaacgagcuggggguccccuuccaccucggcaccaagcaggucugcaucgcguggagcuccucguccugccacgacgggaaggccuggcugcacaucugcgugaccggcgacgacaagaacgccaccgccucgaucaucuacgacgggaugcugguggacuccaucggcucgugguccaagaacauccuccgcacgcaggagagcgagugcgugugcaucaacgggaccugcgcgguggucaugaccgacgggucggccuccggcaaggccgacacccggauccuguucauccgcgaggggaagaucaucaacaucucgccccuguccggcagcgcccagcacguggaggagugcuccugcuacccccgguacccggaggugcgcugcgucugccgggacaacuggaagggcucgaaccgccccgugcucuacaucaacauggccgacuacuccaucgagucguccuacgugugcagcgggcuggucggcgacacgccccgggacgacgacuccucguccucguccaacugccgcgaccccaacaacgagcggggcgcgccgggcgugaaggggugggccuucgacgacggcaacgacaucuggaugggccgcaccaucaagucggacucccggagcggguacgagaccuuccgcguggucaacggcuggaccacggccaacuccaagucgcagaucaaccgccaggugaucguggacucggacuccuggagcggguacuccggcaucuucucggucgaggggaagaacugcaucaaccggugcuucuacguggagcugauccggggccgcccccaggagacccgcgucugguggaccuccaacucgaucaucguguucugcggcaccuccgggacguacggcaccgggagcuggcccgacggcgccgacaucaaccucaugcccaucuga

SEQ ID NO: 25971 - RNA, 1401 nt, Artificial Sequence
  derived and/or modified CDS sequence (AUadapt) from InfluenzaA__AGQ81787__NA
augaaccccaaccagaagaucaucgccaucggcucggugucccugaucaucgccaucaucugccuccugaugcagaucgcgauccugaccaccacgaugacccuccacuuccgccagaacgagugcucgaacccguccaacaaccaggucgugcccugcgagcccaucaucaucgagcggaacaccgugcaccugaacagcaccacgaucgagcgcgagaucugccccaaggucgccgaguacaagaacugguccaagccgcagugccagaucaccggguucgcccccuucucgaaggacaacuccauccggcugucggccggcggggacaucugggugacccgcgagcccuacguguccugcagccucgacaagugcuaccaguucgcccugggccaggggaccacgcugaagaacaagcacuccaacggcaccacccacgaccggacgccccaccgcacccuccugaugaacgagcugggcgucccguuccaccucgggaccaagcaggucugcaucgcguggucguccucguccugcuacgacggcaaggccuggcugcacaucugcgugaccggggacgacaagaacgccaccgccagcaucaucuacgacggcaugcugguggacuccaucgggucgugguccaagaacauccuccggacgcaggagucggagugcgugugcaucaacgggaccugcgcgguggucaugaccgacggcagcgccuccggcaaggccgacacccgcgugcuguucauccgggagggcaagaucaucaacaucucgccccuguccgggucggcccagcacguggaggagugcuccugcuacccccgcuaccccgagguccggugcgugugccgcgacaacuggaagggcagcaaccggccgauccucuacaucaacauggccgacuacuccaucgagucguccuacgugugcucgggccuggucggggacacgccccgcaacgacgacuccagcuccucguccaacugccgggaccccaacaacgagcgcggcgcgcccggggugaagggcugggccuucgacgacgggaacgacguguggaugggccggaccaucaagaacggcucgcgcuccggguacgagaccuuccgggucgugaacggcuggaccauggccaacagcaagucccagaucaaccgccaggugaucgucgacucggacgacuggucgggguacuccggcaucuucagcguggaggggaagaagugcaucaaccggugcuucuacgucgagcugauccgcggccgcccgcaggagccccgggugugguggacguccaacucgaucaucguguucugcggcaccuccgggaccuacggcaccgggagcuggcccgacggcgccaacaucaacuucaugcccaucuga

SEQ ID NO: 25972 - RNA, 1401 nt, Artificial Sequence
  derived and/or modified CDS sequence (AUadapt) from InfluenzaA__AGQ81789__NA
augaaccccaaccagaagaucaucgccaucggcucggugucccugaccaucgccaucaucugccuccugaugcagaucgcgauccugaccacgaccaugaccccgcacuuccgccagaacgagugcucgaaccccuccaacaaccaggucgugcccugcgagcccaucaucaucgagcggaacaccgugcaccucaacucgacgaccaucgagaaggagaucugcccgaaggucgccgaguacaagaacugguccaagccccagugccagaucaccggguucgcccccuucagcaaggacaacuccauccgccugucggccggcggggacaucugggugacccgggagcccuacguguccugcucgcugggcaagugcuaccaguucgcccucgggcagggcacgacccugaagaacaagcacuccaacggcaccacccacgaccgcaucccgcaccggacgcugcucaugaacgagcuggggguccccuuccaccugggcaccaagcaggucugcaucgcguggucguccagcuccugccacgacgggaaggccuggcuccacaucugcgugaccggcgacgacaagaacgccaccgccucgaucaucuacgacgggaugcugguggacuccaucggcucgugguccaagaacauccugcgcacgcaggagucggagugcgugugcaucaacgggaccugcgcgguggucaugaccgacgggagcgccuccggcaaggccgacacccggauccucuucauccgcgaggggaagaucaucaacaucucgccccuguccggcucggcccagcacguggaggagugcuccugcuacccccgguacccggaggugcgcugcgucugccgggacaacuggaagggcucgaaccgccccgugcuguacaucaacauggccgacuacuccaucgagagcuccuacgugugcucggggcucgucggcgacacgccccgggacgacgacuccucguccucguccaacugccgcgaccccaacaacgagcggggcgcgccgggcgugaaggggugggccuucgacgacggcaacgacaucuggaugggccgcaccaucaagagcgacucccggucgggguacgagaccuuccgcguggucaacggcuggaccacggccaacuccaagucgcagaucaaccgccaggugaucguggacucggacuccuggagcggguacuccggcaucuucucggucgaggggaagaacugcaucaaccggugcuucuacguggagcugauccggggccgcccccaggagacccgcgucugguggaccuccaacucgaucaucguguucugcggcaccuccgggacguacggcaccgggagcuggcccgacggcgccgacaucaaccugaugcccaucuga

SEQ ID NO: 25973 - RNA, 1401 nt, Artificial Sequence
  derived and/or modified CDS sequence (AUadapt) from InfluenzaA__AGQ81790__NA
augaaccccaaccagaagaucaucgccaucggcucggugucccugaucaucgccaucaucugccuccugaugcagaucgcgauccugaccaccacgaugacccuccacuuccgccagaacgagugcucgaacccguccaacaaccaggccaugcccugcgagcccaucaucaucgagcggaacaccguccaccugaacucgaccacgaucgagcgcgagaucugccccaaggugaccgaguacaagaacugguccaagccgcagugccagaucaccggguucgcccccuucagcaaggacaacuccauccggcugucggccggcggggacaucugggugacccgcgagcccuacgucuccugcucgcucgacaagugcuaccaguucgcccugggccaggggacgacccugaagaacaagcacuccaacggcaccacccacgaccggacgccccaccgcacccuccugaugaacgagcugggcgugccguuccaccucgggaccaagcaggucugcaucgcguggucguccagcuccugcuacgacggcaaggccuggcugcacaucugcgugaccggggacgacaagaacgccacggccucgaucaucuacgacggcaugcugguggacuccaucgggucgugguccaagaacauccuccggacccaggagagcgagugcgugugcaucaacgggaccugcgcggucgugaugaccgacggcucggccuccggccgcgccgacacgcgggugcuguucauccgcgagggcaagaucaucaacaucucgccccuguccgggaacgcccagcacgucgaggagugcucgugcuacccccgguaccccgaggugcgcugcgugugccgggacaacuggaagggcuccaaccgcccgauccucuacaucaacauggccgacuacagcaucgaguccucguacgucugcuccggccuggugggggacacgccccggaacgacgacucguccagcuccucgaacugccgcgaccccaacaacgagcggggcgcgcccggggugaagggcugggccuucgacgacgggaacgacgucuggaugggccgcaccaucaagaacggcucccggucgggguacgagaccuuccgcguggugaacggcuggaccauggccaacuccaagucgcagaucaaccggcaggucaucguggacuccgacgaguggagcggguacucgggcaucuucuccguggaggggaagaagugcaucaaccgcugcuucuacgucgagcugauccgcggccggccgcaggagccccgcgugugguggaccucgaacuccaucaucgucuucugcggcaccagcgggaccuacggcacgggguccuggcccgacggcgccaacaucaacuucaugcccaucuga

SEQ ID NO: 25974 - RNA, 1401 nt, Artificial Sequence
  derived and/or modified CDS sequence (AUadapt) from InfluenzaA__AGQ81792__NA
augaaccccaaccagaagaucaucgccaucggcucggugucccugaucaucgccaucaucugccuccugaugcagaucgcgauccugaccaccacgaugacccuccacuuccgccagaacgagugcucgaacccguccaacaaccaggucaugcccugcgagcccaucaucaucgagcggaacaccgugcaccugaacagcaccacgaucgagcgcgagaucugccccaagguggccgaguacaagaacugguccaagccgcagugccagaucaccggguucgcccccuucucgaaggacaacuccauccggcugucggccggcggggacaucugggucacccgcgagcccuacguguccugcagccucaacaagugcuaccaguucgcccugggccaggggaccacgcuggagaacaagcacuccaacggcaccacccacgaccggacgccccaccgcacccuccugaugaacgagcugggcgugccguuccaccucgggaccaagcaggucugcauggcguggucguccucguccugcuacgacggcaaggccuggcugcacaucugcgugaccggggacgacaagaacgccaccgccagcgugaucuacgacggcaugcuggucgacuccaucgggucguggucccagaacauccuccggacgcaggagucggagugcgugugcaucaacgggaccugcgcgguggucaugaccgacggcagcgccuccggcaaggccgacacccgcgugcuguucauccgggagggcaagaucaucaacaucucgccccuguccgggucggcccagcacguggaggagugcuccugcuacccccgcuaccccgagguccggugcgugugccgcgacaacuggaagggcagcaaccggccgauccucuacaucaacauggccgacuacuccaucgagucguccuacgugugcucgggccuggucggggacacgccccgcaacgacgacuccagcuccucguccaacugccgggaccccaacaacgagcgcggcgcgcccggggugaagggcugggccuucgacgacgggaacgacguguggaugggccggaccaucaagaacggcucgcgcuccggguacgagaccuuccgggucgugaacggcuggaccauggccaacagcaagucccagaucaaccgccaggugaucgucgacucggacgacuggucgggguacuccggcaucuucagcguggaggggaagaagugcaucaaccggugcuucuacgucgagcugauccgcggccgcccgcaggagccccgggugugguggacguccaacucgaucaucguguucugcggcaccuccgggaccuacggcaccgggagcuggcccgacggcgccaacaucaacuucaugcccaucuga

SEQ ID NO: 25975 - RNA, 1401 nt, Artificial Sequence
  derived and/or modified CDS sequence (AUadapt) from InfluenzaA__AGQ81793__NA
augaaccccaaccagaagaucaucgccaucggcucggugucccugaucaucgccaucaucugccuccugaugcagaucgcgauccugaccaccacgaugacccuccacuuccgccagaacgagugcucgaacccguccaacaaccaggucaugcccugcgagcccaucaucaucgagcggaacaccgugcaccugaacagcaccacgaucgagcgcgagaucugccccaagguggccgaguacaagaacugguccaagccgcagugccagaucaccggguucgcccccuucucgaaggacaacuccauccggcugucggccggcggggacaucugggucacccgcgagcccuacguguccugcagccucaacaagugcuaccaguucgcccugggccaggggaccacgcuggagaacaagcacuccaacggcaccacccacgaccggacgccccaccgcacccuccugaugaacgagcugggcgugccguuccaccucgggaccaagcaggucugcauggcguggucguccucguccugcuacgacggcaaggccuggcugcacaucugcgugaccggggacgacaagaacgccaccgccagcgugaucuacgacggcaugcuggucgacuccaucgggucgugguccaagaacauccuccggacgcaggagucggagugcgugugcaucaacgggaccugcgcgguggucaugaccgacggcagcgccuccggcaaggccgacacccgcgugcuguucauccgggagggcaagaucaucaacaucucgccccuguccgggucggcccagcacguggaggagugcuccugcuacccccgcuaccccgagguccggugcgugugccgcgacaacuggaagggcagcaaccggccgauccucuacaucaacauggccgacuacuccaucgagucguccuacgugugcucgggccuggucggggacacgccccgcaacgacgacuccagcuccucguccaacugccgggaccccaacaacgagcgcggcgcgcccggggugaagggcugggccuucgacgacgggaacgacguguggaugggccggaccaucaagaacggcucgcgcuccggguacgagaccuuccgggucgugaacggcuggaccauggccaacagcaagucccagaucaaccgccaggugaucgucgacucggacgacuggucgggguacuccggcaucuucagcguggaggggaagaagugcaucaaccggugcuucuacgucgagcugauccgcggccgcccgcaggagccccgggugugguggacguccaacucgaucaucguguucugcggcaccuccgggaccuacggcaccgggagcuggcccgacggcgccaacaucaacuucaugcccaucuga

SEQ ID NO: 25976 - RNA, 1401 nt, Artificial Sequence; identical to SEQ ID NO: 25975
  derived and/or modified CDS sequence (AUadapt) from InfluenzaA__AGQ81794__NA

SEQ ID NO: 25977 - RNA, 1401 nt, Artificial Sequence
  derived and/or modified CDS sequence (AUadapt) from InfluenzaA__AGQ81795__NA
augaaccccaaccagaagaucaucgccaucggcucggugucccugaucaucgccaucaucugccuccugaugcagaucgcgauccugaccaccacgaugacccuccacuuccgccagaacgagugcaacaacccgucgaacaaccaggucaugcccugcgagcccaucaucaucgagcggaacaccgugcaccugaacuccaccacgaucgagcgcgagaucugccccaagguggccgaguacaagaacuggucgaagccgcagugccagaucaccggguucgcccccuucuccaaggacaacagcauccggcuguccgccggcggggacaucugggucacccgcgagcccuacgugucgugcucccucgacaagugcuaccaguucgcccugggccaggggaccacgcugaagaacaagcacucgaacggcaccacccacgaccggacgccccaccgcacccuccugaugaacgagcugggcgugccguuccaccucgggaccaagcaggucugcaucgcgugguccagcuccucgugcuacgacggcaaggccuggcugcacaucugcgugaccggggacgacaagaacgccaccgccuccaucaucuacgacggcaugcugguggacucgaucggguccuggagcaagaacauccuccggacgcaggaguccgagugcgucugcaucaacgggaccugcgcgguggugaugaccgacggcucggccucgggcaaggccgacacccgcguccuguucauccgggagggcaagaucaucaacaucagcccccuguccggguccgcccagcacguggaggagugcucgugcuacccccgcuaccccgaggugcggugcgucugccgcgacaacuggaagggcuccaaccggccgauccucuacaucaacauggccgacuacucgaucgaguccagcuacgugugcuccggccuggugggggacacgccccgcaacgacgacucguccucguccagcaacugccgggaccccaacaacgagcgcggcgcgcccggggucaagggcugggccuucgacgacgggaacgacguguggaugggccggaccaucaagaacggcucccgcucgggguacgagaccuuccggguggucaacggcuggaccaucgccaacuccaagucgcagaucaaccgccagaucaucguggacuccgacgacuggagcggguacucgggcaucuucuccguggaggggaagaagugcaucaaccggugcuucuacgucgagcugauccgcggccgcccgcaggagccccgggugugguggacgucgaacuccaucaucgucuucugcggcaccagcgggaccuacggcaccggguccuggcccgacggcgccaacaucaacuucaugcccaucuga

SEQ ID NO: 25978 - RNA, 1401 nt, Artificial Sequence
  derived and/or modified CDS sequence (AUadapt) from InfluenzaA__AGQ81796__NA
augaaccccaaccagaagaucaucgccaucggcucggugucccugaucaucgccaucaucugccuccugaugcagaucgcgauccugaccaccacgaugacccuccacuuccgccagaacgagugcucgaacccguccaacaaccaggucaugcccugcgagcccaucaucaucgagcggaacaccgugcaccugaacagcaccacgaucgagcgcgagaucugccccaagguggccgaguacaagaacugguccaagccgcagugccagaucaccggguucgcccccuucucgaaggacaacuccauccggcugucggccggcggggacaucugggucacccgcgagcccuacguguccugcagccucgacaagugcuaccaguucgcccugggccaggggaccacgcugaagaacaagcacuccaacggcaccacccacgaccggacgccccaccgcacccuccugaugaacgagcugggcgugccguuccaccucgggaccaagcaggucugcaucgcguggucguccucguccugcuacgacggcaaggccuggcugcacaucugcgugaccggggacgacaagaacgccaccgccagcaucaucuacgacggcaugcugguggacuccaucgggucgugguccaagaacauccuccggacgcaggagucggagugcgucugcaucaacgggaccugcgcgguggugaugaccgacggcagcgccuccggcaaggccgacacccgcguccuguucauccgggagggcaagaucaucaacaucucgccccuguccgggucggcccagcacguggaggagugcuccugcuacccccgcuaccccgaggugcggugcgucugccgcgacaacuggaagggcagcaaccggccgauccucuacaucaacauggccgacuacuccaucgagucguccuacgugugcucgggccuggugggggacacgccccgcaacgacgacuccagcuccucguccaacugccgggaccccaacaacgagcgcggcgcgcccggggucaagggcugggccuucgacgacgggaacgacaucuggaugggccggaccaucaagaacggcucgcgcuccggguacgagaccuuccggguggugaacggcuggaccauggccaacagcaagucccagaucaaccgccaggucaucguggacucggacgacuggucgggguacuccggcaucuucagcguggaggggaagaagugcaucaaccggugcuucuacgucgagcugauccgcggccgcccgcaggagccccgggugugguggacguccaacucgaucaucgucuucugcggcaccuccgggaccuacggcaccgggagcuggcccgacggcgccaacaucaacuucaugcccaucuga

SEQ ID NO: 25979 - RNA, 1401 nt, Artificial Sequence
  derived and/or modified CDS sequence (AUadapt) from InfluenzaA__AGQ81798__NA
augaaccccaaccagaagaucaucucgaucggcuccgugucgcugaucaucgccaucaucugccuccugaugcagaucgccauccugaccaccacgaugacccuccacuuccgccagaacgagugcuccaacccgagcaacaaccaggucaugcccugcgagcccaucaucaucgagcggaacaccgugcaccugaacuccaccacgaucgagcgcgagaucugccccaagguggcggaguacaagaacuggucgaagccgcagugccagaucaccggguucgcccccuucuccaaggacaacucgauccggcuguccgccggcggggacaucugggucacccgcgagcccuacgugagcugcucccucgacaagugcuaccaguucgcccugggccaggggaccacgcugaagaacaagcacucgaacggcaccacccacgaccggacgccccaccgcacccuccugaugaacgagcugggcgugccguuccaccucgggaccaagcaggucugcaucgccugguccagcuccucgugcuacgacggcaaggcguggcugcacaucugcgugaccggggacgacaagaacgccaccgccuccaucaucuacgacggcaugcugguggacucgaucggguccuggagcaagaacauccuccggacgcaggagucggagugcgucugcaucaacgggaccugcgccguggugaugaccgacggcuccgcgagcggcaaggccgacacccgcguccuguucauccgggagggcaagaucaucaacaucucgccccuguccggguccgcccagcacguggaggagugcucgugcuacccccgcuaccccgaggugcggugcgucugccgcgacaacuggaagggcuccaaccggccgauccucuacaucaacauggccgacuacagcaucgaguccucguacgugugcuccggccuggugggggacacgccccgcaacgacgacucguccagcuccucgaacugccgggaccccaacaacgagcgcggcgcccccggggucaagggcugggcguucgacgacgggaacgacguguggaugggccggaccaucaagaacggcucccgcagcggguacgagaccuuccggguggucaacggcuggaccauggccaacuccaagucgcagaucaaccgccaggugaucguggacucggacgacugguccggguacagcggcaucuucuccgucgaggggaagaagugcaucaaccggugcuucuacguggagcugauccgcggccgcccgcaggagccccgggucugguggacgucgaacuccaucaucguguucugcggcaccagcgggaccuacggcaccggguccuggcccgacggcgccaacaucaacuucaugcccaucuga

SEQ ID NO: 25980 - RNA, 1401 nt, Artificial Sequence
  derived and/or modified CDS sequence (AUadapt) from InfluenzaA__AGQ81799__NA
augaaccccaaccagaagaucaucgccaucggcucggugucccugaucaucgccaucaucugccuccugaugcagaucgcgauccugaccaccacgaugacccuccacuuccgccagaacgagugcucgaacccguccaacaaccaggucaugcccugcgagcccaucaucaucgagcggaacaccgugcaccugaacagcaccacgaucgagcgcgagaucugccccaagguggccgaguacaagaacugguccaagccgcagugccagaucaccggguucgcccccuucucgaaggacaacuccauccggcugucggccggcggggacaucugggucacccgcgagcccuacguguccugcagccucgacaagugcuaccaguucgcccugggccaggggaccacgcugaagaacaagcacuccaacggcaccacccacgaccggacgccccaccgcacccuccugaugaacgagcugggcgugccguuccaccucgggaccaagcaggucugcaucgcguggucguccucguccugcuacgacggcaaggccuggcugcacaucugcgugaccggggacgacaagaacgccaccgccagcaucaucuacgacggcaugcugguggacuccaucgggucgugguccaagaacauccuccggacgcaggagucggagugcgucugcaucaacgggaccugcgcgguggugaugaccgacggcagcgccuccggcaaggccgacacccgcguccuguucauccgggagggcaagaucaucaacaucucgccccuguccgggucggcccagcacguggaggagugcuccugcuacccccgcuaccccgaggugcggugcgucugccgcgacaacuggaagggcagcaaccggccgauccucuacaucaacauggccgacuacuccaucgagucguccuacgugugcucgggccuggugggggacacgccccgcaacgacgacuccagcuccucguccaacugccgggaccccaacaacgagcgcggcgcgcccggggucaagggcugggccuucgacgacgggaacgacguguggaugggccggaccaucaagaacggcucgcgcuccggguacgagaccuuccggguggucaacggcuggaccauggccaacagcaagucccagaucaaccgccaggugaucguggacucggacgacuggucgggguacuccggcaucuucagcgucgaggggaagaagugcaucaaccggugcuucuacguggagcugauccgcggccgcccgcaggagccccgggucugguggacguccaacucgaucaucguguucugcggcaccuccgggaccuacggcaccgggagcuggcccgacggcgccaacaucaacuucaugcccaucuga

SEQ ID NO: 25981 - RNA, 1401 nt, Artificial Sequence; identical to SEQ ID NO: 25980
  derived and/or modified CDS sequence (AUadapt) from InfluenzaA__AGQ81800__NA

SEQ ID NO: 25982 - RNA, 1401 nt, Artificial Sequence
  derived and/or modified CDS sequence (AUadapt) from InfluenzaA__AGQ81801__NA
augaaccccaaccagaagaucaucgccaucggcucggugucccugaucaucgccaucaucugccuccugaugcagaucgcgauccugaccaccacgaugacccuccacuuccgccagaacgagugcucgaacccguccaacaaccaggucaugcccugcgagcccaucaucaucgagcggaacaccgugcaccugaacagcaccacgaucgagcgcgagaucugccccaagguggccgaguacaagaacugguccaagccgcagugccagaucaccggguucgcccccuucucgaaggacaacuccauccggcugucggccuccggcgacaucugggucacccgcgagcccuacgugagcugcucccucgacaagugcuaccaguucgcccuggggcagggcaccacgcugaagaacaagcacucgaacgggaccacccacgaccggacgccccaccgcacccuccugaugaacgagcugggcgugccguuccaccucggcaccaagcaggucugcaucgcgugguccagcuccucgugcuacgacgggaaggccuggcugcacaucugcgugaccggcgacgacaagaacgccaccgccuccaucaucuacgacgggaugcugguggacucgaucggcuccuggagcaagaacauccuccggacgcaggagucggagugcgucugcaucaacgggaccugcgcgguggugaugaccgacggcuccgccagcggcaaggccgacacccgcguccuguucauccgggaggggaagaucaucaacaucucgccccuguccggcuccgcccagcacguggaggagugcucgugcuacccccgcuaccccgaggugcggugcgucugccgcgacaacuggaagggguccaaccggccgauccucuacaucaacauggccgacuacagcaucgaguccucguacgugugcuccggccuggugggcgacacgccccgcaacgacgacucguccagcuccucgaacugccgggaccccaacaacgagcgcggggcgcccggcgucaaggggugggccuucgacgacggcaacgacguguggauggggcggaccaucaagaacggcucccgcagcggcuacgagaccuuccggguggucaacggguggaccauggccaacuccaagucgcagaucaaccgccaggugaucguggacucggacgacugguccggcuacagcgggaucuucuccgucgagggcaagaagugcaucaaccggugcuucuacguggagcugauccgcgggcgcccgcaggagccccgggucugguggacgucgaacuccaucaucguguucugcggcaccagcggcaccuacgggaccggcuccuggcccgacggggccaacaucaacuucaugcccaucuga

SEQ ID NO: 25983 - RNA, 1401 nt, Artificial Sequence
  derived and/or modified CDS sequence (AUadapt) from InfluenzaA__AGQ81802__NA
augaaccccaaccagaagaucaucgccaucggcucggugucccugaucaucgccaucaucugccuccugaugcagaucgcgcugcucaccaccacgaugacccugcacuuccgccagaacgagugcucgaacccguccaacaaccaggucaugcccugcgagcccaucaucaucgagcggaacaccgugcaccugaacagcaccacgaucgagcgcgagaucugccccaagguggccgaguacaagaacugguccaagccgcagugccagaucaccggguucgcccccuucucgaaggacaacuccauccggcucucggccggcggggacaucugggucacccgcgagcccuacguguccugcagccuggacaagugcuaccaguucgcccugggccaggggaccacgcucaagaacaagcacuccaacggcaccacccacgaccggacgccccaccgcacccugcugaugaacgagcucggcgugccguuccaccuggggaccaagcaggucugcaucgcguggucguccucguccugcuacgacggcaaggccuggcugcacaucugcgugaccggggacgacaagaacgccaccgccagcaucaucuacaacggcaugcucguggacuccaucgggucgugguccaagaacauccugcggacgcaggagucggagugcgucugcaucaacgggaccugcgcgguggugaugaccgacggcagcgccuccggcaaggccgacacccgcguccuguucauccgggagggcgagaucaucaacaucucgccccucuccgggucggcccagcacguggaggagugcuccugcuacccccgcuaccccgaggugcggugcgucugccgcgacaacuggaagggcagcaaccggccgauccuguacaucaacauggccgacuacuccaucgagucguccuacgugugcucgggccuggugggggacacgccccgcaacgacgacuccagcuccucguccaacugccgggaccccaacaacgagcgcggcgcgcccggggucaagggcugggccuucgacgacgggaacgacguguggaugggccggaccaucaagaacggcucgcgcuccggguacgagaccuuccggguggucaacggcuggaccauggccaacagcaagucccagaucaaccgccaggugaucguggacucggacgacuggucgggguacuccggcaucuucagcgucgaggggaagaagugcaucaaccggugcuucuacguggagcucauccgcggccgcccgcaggagccccgggucugguggacguccaacucgaucaucguguucugcggcaccuccgggaccuacggcaccgggagcuggcccgacggcgccaacaucaacuucaugcccaucuga

SEQ ID NO: 25984 - RNA, 1401 nt, Artificial Sequence
  derived and/or modified CDS sequence (AUadapt) from InfluenzaA__AGQ81803__NA
augaaccccaaccagaagaucaucgccaucggcucggugucccugaucaucgccaucaucugccuccugaugcagaucgcgauccugaccaccacgaugacccuccacuuccgccagaacgagugcucgaacccguccaacaaccaggucaugcccugcgagcccaucaucaucgagcggaacaccgugcaccugaacagcaccacgaucgagcgcgagaucugccccaagguggccgaguacaagaacugguccaagccgcagugccagaucaccggguucgcccccuucucgaaggacaacuccauccggcugagcgccuccggcgacaucugggucacccgcgagcccuacgugucgugcucccucgacaagugcuaccaguucgcccuggggcagggcaccacgcugaagaacgagcacucgaacgggaccacccacgaccggacgccccaccgcacccuccugaugaacgagcugggcgugccguuccaccucggcaccaagcaggucugcaucgcgugguccagcuccucgugcuacgacgggaaggccuggcugcacaucugcgugaccggcgacgacaagaacgccaccgccuccaucaucuacgacgggaugcugguggacagcaucggcuccuggucgaagaacauccuccggacgcaggagagcgagugcgucugcaucaacgggaccugcgcgguggugaugaccgacggcuccgccucgggcaaggccgacacccgcguccuguucauccgggaggggaagaucaucaacaucucgccccuguccggcuccgcccagcacguggaggagugcagcugcuacccccgcuaccccgaggugcggugcgucugccgcgacaacuggaagggguccaaccggccgauccucuacaucaacauggccgacuacucgaucgaguccagcuacgugugcuccggccuggugggcgacacgccccgcaacgacgacucguccagcuccucgaacugccgggaccccaacaacgagcgcggggcgcccggcgucaaggggugggccuucgacgacggcaacgacguguggauggggcggaccaucaagaacggcucccgcucgggcuacgagaccuuccggguggucaacggguggaucauggccaacuccaagagccagaucaaccgccaggugaucguggacucggacgacugguccggcuacagcgggaucuucuccgucgagggcaagaagugcaucaaccggugcuucuacguggagcugauccgcgggcgcccgcaggagccccgggucugguggaccucgaacuccaucaucguguucugcggcacgagcggcaccuacgggaccggcuccuggcccgacggggccaacaucaacuucaugcccaucuga

SEQ ID NO: 25985 - RNA, 1410 nt, Artificial Sequence
  derived and/or modified CDS sequence (AUadapt) from InfluenzaA__AGQ81804__NA
augaaucccaaccagaagaugaucgccaucggcgccgugucgcugaccaucgcgaucaucugccuccugaugcagaccgccauccuggucacgaccaugacccuccacuucaagcacaacgagugcaccaacuccucgaacaaccaggccgccccgugcgggcccaucaucaucgagcgcaacgugacggaggugguccaccugaacuccaccacccuggagaaggagaucugccccaaggccgcgggcuaccggaacuggagcaagccccagugccagaucaccggguucgccccguucuccaaggacaacucgauccgccucuccgccggcggggacaucugggugacgcgggagcccuaugugagcugcggccugggcaagugcuaccaguucgcccuggggcagggcaccacccucgacaacucccacucgaacgggaccucccacgaccgcacgccccaccggacccugcugaugaacgagcucggcguccccuuccaccugaugaccaagcaggucugcaucgcguggucguccagcuccugccacgacgggaaggccuggcugcacgugugcgugaccggcgacgaccgcaacgccacggccaguaucaucuacggcgggauccucguggacuccaucggcagcugguccaagaacauccugcggacccaggagucggagugcgugugcaucaacgggaccugcgccgucgugaugaccgacggcagcgcguccggcaaggccgacacgcgcauccuguucauccgggaggggaagaucgugcacaucucgccgcucuccggcucggcccagcacgucgaggagugcuccugcuacccccaguaccccgaggugcgcugcgugugccgggacaacuggcgcgggagcaaccggcccguccuguauaucaacauggccgacuacuccaucgacucgggcuacgugugcuccgggcuggugggcgacaccccgcgcaacgacgacgucagcuccucguccaacugcaaggaccccaacaacgagcggggcgcccccggggugaagggcugggcguucgacaacgggaacgacaucuggaugggccgcaccaucgacaaggacagccgguccggguacgagaccuuucgcgugaucgacggcuggaacacggccaacucgaagucccagaccucgcggcaggucaucgugggcuccgacaacagcucgggguacuccggcaucuucagcgucgaggggaaguccugcaucaaccgcugcuucuacguggagcucauccggggccgccccaaggagacccgcgugugguggaccucgaacuccaucaucgucuucugcgggacgagcggcaccuacggcaccggguccuggccggacggcgccaacaucaacuucaugcccaucuga

SEQ ID NO: 25986 - RNA, 1401 nt, Artificial Sequence
  derived and/or modified CDS sequence (AUadapt) from InfluenzaA__AGQ81805__NA
augaaccccaaccagaagaucaucgccaucggcucggugucccugaucaucgccaucaucugccuccugaugcagaucgcgcugcucaccaccacgaugacccugcacuuccgccagaacgagugcucgaacccguccaacaaccaggucaugcccugcgagcccaucaucaucgagcggaacaccgugcaccugaacagcaccacgaucgagcgcgagaucugccccaagguggccgaguacaagaacugguccaagccgcagugccagaucaccggguucgcccccuucucgaaggacaacuccauccggcucucggccggcggggacaucugggucacccgcgagcccuacguguccugcagccuggacaagugcuaccaguucgcccugggccaggggaccacgaugaagaacaagcacuccaacggcaccacccacgaccggacgccccaccgcacccuccugaugaacgagcugggcgugccguuccaccucgggaccaagcaggucugcaucgcguggucguccucguccugcuacgacggcaaggccuggcugcacaucugcgugaccggggacgacaagaacgccaccgccagcaucaucuacgacggcaugcugguggacuccaucgggucgugguccaagaacauccuccggacgcaggagucggagugcgucugcaucaacgggaccugcgcgguggugaugaccgacggcagcgccuccggcaaggccgacacccgcguccuguucauccgggagggcaagaucaucaacaucucgccccuguccgggucggcccagcacguggaggagugcuccugcuacccccgcuaccccgaggugcggugcgucugccgcgacaacuggaagggcagcaaccggccgauccucuacaucaacauggccgacuacuccaucgagucguccuacgugugcucgggccuggugggggacacgccccgcaacgacgacuccagcuccucguccaacugccggggccccaacaacgagcgcggggcgcccggcgucaaggggugggccuucgacgacggcaacgacguguggaugggccggaccaucaagaacgggucgcgcuccggcuacgagaccuuccggguggucaacggguggaccauggccaacagcaagucccagaucaaccgccaggugaucguggacucggacgacuggucgggcuacuccgggaucuucagcgucgagggcaagaagugcaucaaccggugcuucuacguggagcugauccgcggccgcccgcaggagccccgggucugguggacguccaacucgaucaucguguucugcgggaccuccggcaccuacgggaccggcagcuggcccgacggggccaacaucaacuucaugcccaucuga

SEQ ID NO: 25987 - RNA, 1401 nt, Artificial Sequence
  derived and/or modified CDS sequence (AUadapt) from InfluenzaA__AGQ81807__NA
augaaccccaaccagaagaucaccgccaucggcucgaucucccugaucaucgccaucaucugccuccugaugcagaucgcgauccugaccacgaccaugacccuccacuuccgccagaacgagugccggaacccgucgaacaaccaggugaugcccugcgagcccgucaucaucgagcgcaacaccgugcaccugaacuccacgaccaucgagcgggagaucugccccaagguggccgaguacaagaacuggagcaagccgcagugccagaucaccggguucgcccccuucuccaaggacaacucgauccgccuguccgccucgggcgacaucugggucacccgggagcccuacguguccugcagccucaacaagugcuaccaguucgcccuggggcagggcacgacccugaagaacaagcacuccaacgggaccacccacgaccgcacgccccaccggacccuccugaugaacgagcugggcgugccguuccaccucggcaccaagcaggucugcaucgcguggucguccucguccugcuacgacgggaaggccuggcugcacaucugcgugaccggcgacgacaagaacgccacggccagcaucaucuacgacgggaugcugguggacuccaucggcucgugguccaagaacauccuccgcacccaggagucggagugcgucugcaucaacgggaccugcgcgguggugaugaccgacggcagcgccuccggcaaggccgacacgcggguccuguucaucaaggaggggaagaucaucaacaucucgccccuguccggcucggcccagcacguggaggagugcuccugcuacccccgcuaccccgaggugcggugcgucugccgcgacaacuggaaggggagcaaccggccgauccucuacaucaacauggccgacuacuccaucgagucguccuacgugugcucgggccuggugggcgacacgccccgcaacgacgacuccagcuccucguccaacugccgggaccccaacaacgagcgcggggcgcccggcgucaaggggugggccuucgacgacggcaacgacguguggauggggcggaccaucaagaacggcucgcgcuccggcuacgagaccuuccggguggucaacggguggaucauggccaacagcaagucccagaucaaccgccaggugaucguggacucggacgacuggucgggcuacuccgggaucuucagcgucgagggcaagaagugcaucaaccggugcuucuacguggagcugauccgcgggcgcccgcaggagccccgggucugguggaccuccaacucgaucaucguguucugcggcaccuccggcaccuacgggaccggcagcuggcccgacggggccaacaucaacuucaugcccaucuga

SEQ ID NO: 25988 - RNA, 1401 nt, Artificial Sequence
  derived and/or modified CDS sequence (AUadapt) from InfluenzaA__AGQ81808__NA
augaaccccaaccagaagaucaucgccaucggcucggugucccugaccaucgccaucaucugcuuccucaugcagaucgcgauccugaccacgaccaugacccugcacuucaagcagaacgagugcucgaacccguccaacaaccaggucgugcccugcgagcccauccucaucgagcgcaacaccgugcaccugaacucgacgaccaucgagaaggaggucugccccaagguggccgaguacaagaacugguccaagccgcagugccagaucaccggguucgcccccuucagcaaggacaacuccauccggcugucggccggcggggacaucugggugacccgcgagcccuacgucuccugcucgcucggcaagugcuaccaguucgcccuggggcagggcacgacccugaagaacaaccacuccaacggcaccacccacgaccggacgccccaccgcacccuccugaugaacgagcugggggugccguuccaccucggcaccaagcaggucugcaucgcguggagcuccucguccugcuacgacgggaaggccuggcugcacaucugcgugaccggcgacgacaagaacgccacggccucgaucaucuacgacgggaugcugguggacuccaucggcagcugguccaagaacauccuccggacccaggagucggagugcgugugcaucaacgggaccugcgcggucgugaugaccgacggcucggccuccggcaaggccgacacgcgcauccuguucauccgggaggggaagaucaucaacaucagcccccuguccggcucggcccagcacguggaggagugcuccugcuacccccgcuaccccgagguccggugcgugugccgcgacaacuggaagggcucgaaccggccggugcucuacaucaacauggccgacuacuccgucgagucguccuacgugugcagcgggcuggugggcgacacgccccgcaacgacgacuccucguccucguccaacugccgggaccccaacaacgagcgcggggcgcccggcgucaaggggugggccuucgacgacggcaacgacguguggaugggccggaccauccgcaacaacagccgguccggguacgagaccuuccgcguggucaacggcuggaccaccgccaacucgaagucccagaucaaccggcagaucaucguggacucggagaacuggagcggguacuccggcaucuucucggucgaggggaagaacugcaucaaccgcugcuucuacguggagcugauccggggccgcccgcaggagccccgcgugugguggaccuccaacucgaucaucgucuucugcggcaccuccgggacguacggcaccgggagcuggcccgacggcgccaacaucaacuucaugcccaucuga

SEQ ID NO: 25989 - RNA, 1401 nt, Artificial Sequence
  derived and/or modified CDS sequence (AUadapt) from InfluenzaA__AGQ81809__NA
augaaccccaaccagaagaucaccgccaucggcucggugucccugaucaucgccaucaucugccuccugaugcagaucgcgauccugaccacgaccaugacccuccacuuccgccagaacgagugcucgaacccguccaacaaccaggucaugcccugcgagcccaucaucaucgagcggaacaccgugcaccugaacucgacgaccaucgagcgcgagaucugccccaagguggccgaguacaagaacugguccaagccgcagugccagaucaccggguucgcccccuucucgaaggacaacuccauccggcugagcgccggcggggacaucugggucacccgcgagcccuacguguccugcucgcccgacaagugcuaccaguucgcccucggccaggggacgacccugaagaacaagcacuccaacggcaccacccacgaccggacgccgcaccgcacccugcucaugaacgagcugggcgugcccuuccaccuggggaccaagcaggucugcaucgcguggucguccucguccugcuacgacggcaaggccuggcuccacaucugcgugaccggggacgacaagaacgccacggccagcaucaucuacgacggcaugcugguggacuccaucgggucgugguccaagaacauccugcggacccaggagucggagugcgucugcaucaacgggaccugcgcgguggugaugaccgacggcucggccuccggggaggccgacacgcgcauccucuucauccgggagggcaagaucaucaacaucagcccccuguccgggucggcccagcacgucgaggagugcuccugcuacccccgcuacccggaggugcggugcgugugccgcgacaacuggaagggcucgaaccggcccaucaucuacaucaacauggucgacuacuccaucggcucgcgcuacgugugcuccgggcuggugggcgacacgccccggaacgacgacagcaccuccucguccaacugccgcgaccccaacaacgagcggggcgccccgggcgucaaggggugggcguucgacgacggcaacgacguguggaugggccgcaccaucaagaacgggucgcgguccggcuacgagaccuuccgcgugaucaacggguggaccauggccaacucgaagucccagaucaaccggcaggucaucguggacagcgacaacugguccggcuacucggggaucuucucgguggagggcaagaagugcaucaaccgcugcuucuacgucgagcucauccgcggccggccccaggagccccgcgugugguggaccuccaacucgaucaucgucuucugcgggaccuccggcacguacgggaccggcagcuggcccgacggggccgacaucaacuucaugccgaucuga

SEQ ID NO: 25990 - RNA, 1401 nt, Artificial Sequence
  derived and/or modified CDS sequence (AUadapt) from InfluenzaA__AGQ81810__NA
augaaccccaaccagaagauccuggccaucggcucggugucccucaccaucgccaucaucugcuuccugaugcagaucgcgauccugaccacgaccaugacccuccacuucaagcagaacgagugcucgaacccguccaacaaccaggucgugcccugcgagcccauccugaucgagcgcaacaccgugcaccugaacucgacgaccaucgagaaggaggucugccccaagguggccgaguacaagaacugguccaagccgcagugccagaucaccggguucgcccccuucagcaaggacaacuccauccggcucucggccggcggggacaucugggugacccgcgagcccuacgucuccugcucgcugggcaagugcuaccaguucgcccuggggcagggcacgacccucaagaacaaccacuccaacggcaccacccacgaccggacgccccaccgcacccugcugaugaacgagcucggggugccguuccaccugggcaccaagcaggucugcaucgcguggagcuccucguccugcuacgacgggaaggccuggcugcacaucugcgugaccggcgacgacaagaacgccacggccucgaucaucuacgacgggaugcucguggacuccaucggcagcugguccaagaacauccugcggacccaggagucggagugcgugugcaucaacgggaccugcgcggucgugaugaccgacggcucggccuccggcaaggccgacacgcgcauccuguucauccgggaggggaagaucaucaacaucagcccccucuccggcucggcccagcacguggaggagugcuccugcuacccccgcuaccccgagguccggugcgugugccgcgacaacuggaagggcucgaaccggccggugcuguacaucaacauggccgacuacuccaucgagucguccuacgucugcagcgggcuggugggcgacacgccccgcaacgacgacuccucguccucguccaacugccgggaccccaacaacgagcgcggggcgcccggcgugaaggggugggccuucgacgacggcaacgacgucuggaugggccggaccauccgcaacaacagccgguccggguacgagaccuuccgcguggugaacggcuggaccaccgccaacucgaagucccagaucaaccggcaggucaucguggacucggagaacuggagcggguacuccggcaucuucucggucgaggggaagaacugcaucaaccgcugcuucuacguggagcucauccggggccgcccgcaggagccccgcgugugguggaccuccaacucgaucaucgucuucugcggcaccuccgggacguacggcaccgggagcuggcccgacggcgccaacaucaacuucaugcccaucuga

SEQ ID NO: 25991 - RNA, 1401 nt, Artificial Sequence
  derived and/or modified CDS sequence (AUadapt) from InfluenzaA__AGQ81811__NA
augaaccccaaccagaagaucaucgccaucggcucggugucccugaccaucgccaucaucugcuuccucaugcagaucgcgauccugaccacgaccaugacccugcacuucaagcagaacgagugcucgaacccguccaacaaccaggucgugcccugcgagcccauccucaucgagcgcaacaccgugcaccugaacagcacgaccaucgagaaggaggucugccccaagguggccgaguacaagaacugguccaagccgcagugccagaucaccggguucgcccccuucucgaaggacaacuccauccggcugucggccggcggggacaucugggugacccgcgagcccuacgucuccugcagccucggcaagugcuaccaguucgcccuggggcagggcacgacccugaagaacaagcacuccaacggcaccacccacgaccggacgccccaccgcacccuccugaugaacgagcugggggugccguuccaccucggcaccaagcaggucugcaucgcguggucguccagcuccugcuacgacgggaaggccuggcugcacaucugcgugaccggcgacgacaagaacgccacggccucgaucaucuacgacgggaugcugguggacuccaucggcucgugguccaagaacauccuccggacccaggagagcgagugcgugugcaucaacgggaccugcgcggucgugaugaccgacggcucggccuccggcaaggccgacacgcgcauccuguucauccgggaggggaagaucgugaacaucagcccccuguccggcucggcccagcacgucgaggagugcuccugcuacccccgcuaccccgaggugcggugcgugugccgcgacaacuggaagggcucgaaccggccgguccucuacaucaacauggccgacuacuccguggagagcuccuacgugugcucggggcuggucggcgacacgccccgcaacgacgacuccuucucguccagcaacugccgggaccccaacaacgagcgcggggcgcccggcgugaaggggugggccuucgacgacggcaacgacguguggaugggccggaccauccgcaacgacucccggucgggguacgagaccuuccgcgucgugaacggcuggaccaccgccaacuccaagagccagaucaaccggcaggucaucguggacuccgagucguggucgggguacuccggcaucuucagcguggaggggaagaacugcaucaaccgcugcuucuacgucgagcugauccggggccgcccgcaggagccccgcgugugguggaccuccaacucgaucaucguguucugcggcaccuccgggacguacggcaccgggagcuggcccgacggcgccaacaucaacuucaugcccaucuga

SEQ ID NO: 25992 - RNA, 1410 nt, Artificial Sequence
  derived and/or modified CDS sequence (AUadapt) from InfluenzaA__AGQ81812__NA
augaaccccaaccagaagaucaucaccaucggcucggugucccugaccaucgccacgaucugcuuccucaugcagaucgccauccuggucaccaccaucacccugcacuucaagcagaacgagugcucgaucccguccaacaaccagguggugcccugcgagcccaucaucgucgagcgcaacaucacggagaucguguaccucaacaacaccaccaucgagaaggagcugugccccaagcugaccgaguaccgggacuggagcaagccgcagugccagaucacgggguucgcgcccuucuccaaggacaacucgauccgccucuccgccggcggggacaucugggugacccgggagcccuacgucagcugcucccccaacaagugcuaccaguucgcccugggccaggggaccacccuggacaacaagcacucgaacggcacgauccacgaccgcaucccgcaccggacccuccugaugaacgagcugggcgugcccuuccaccucgggaccaagcaggucugcaucgccugguccagcuccucgugccacgacggcaaggccuggcugcacgugugcgugaccggggacgaccgcaacgcgacggccuccuucaucuacgacggcaugcugguggacagcaucggguccuggucgcagaacauccuccggacccaggaguccgagugcgucugcaucaacgggaccugcaccguggugaugacggacggcagcgccucgggccgcgccgacacccggauccuguucaucaaggagggcaagaucguccacgugagcccccuguccggguccgcgcagcacaucgaggagugcucgugcuacccccgcuacccggacgugcggugcgucugccgcgacaacuggaagggcuccaaccggcccaucaucgacaucaacguggccgacuacagcaucgacuccucguacgugugcuccggccucgucggggacacgccccgcaacgacgacagcuccucgaacuccaacugcaaggaccccaacaacgagcggggcaacccgggggugaagggcugggccuucgacuacgggaacgacguguggaugggccgcaccaucagcaaggacucccggucgggcuacgagaccuuccgcgucaucgggggcuggaccaccgccaacuccaagagccaggugaaccggcaggucaucguggacaacaacaacugguccggguacucgggcaucuucagcguggaggggaaguccugcaucaaccgcugcuucuacgucgagcugauccggggccgcccccaggagacccgcgugugguggacgucgaacuccaucguggucuucugcggcaccagcgggaccuacggcaccggguccuggcccgacggcgccaacaucaacuucaugcccaucuga

SEQ ID NO: 25993 - RNA, 1401 nt, Artificial Sequence
  derived and/or modified CDS sequence (AUadapt) from InfluenzaA__AGQ81814__NA
augaaccccaaccagaagaucaucgccaucggcucggugucccugaccaucgccaucaugugcuuccucaugcagaucgcgauccugaccacgaccaugacccugcacuucaagcagaacgagugcucgaacccguccaacaaccaggucgugcccugcgagcccauccucaucgagcgcaacaccgugcaccugaacucgacgaccaucgagaaggaggucugccccaagguggccgaguacaagaacugguccaagccgcagugccagaucaccggguucgcccccuucagcaaggacaacuccauccggcugucggccggcggggacaucugggugacccgcgagcccuacgucuccugcucgcucggcaagugcuaccaguucgcccuggggcagggcacgacccugaagaacaaccacuccaacggcaccacccacgaccggacgccccaccgcacccuccugaugaacgagcugggggugccguuccaccucggcaccaagcaggucugcaucgcguggagcuccucguccugcuacgacgggaaggccuggcugcacaucugcgugaccggcgacgacaagaacgccacggccucgaucaucuacgacgggaugcugguggacuccaucggcagcugguccaagaacauccuccggacccaggagucggagugcgugugcaucaacgggaccugcgcggucgugaugaccgacggcucggccuccggcaaggccgacacgcgcauccuguucauccgggaggggaagaucaucaacaucagcccccuguccggcucggcccagcacguggaggagugcuccugcuacccccgcuaccccgagguccggugcgugugccgcgacaacuggaagggcucgaaccggccggugcucuacaucaacauggccgacuacuccgucgagucguccuacgugugcagcgggcuggugggcgacacgccccgcaacgacgacuccucguccucguccaacugccgggaccccaacaacgagcgcggggcgcccggcgucaaggggugggccuucgacgacggcaacgacguguggaugggccggaccauccgcaacaacagccgguccggguacgagaccuuccgcguggucaacggcuggaccaccgccaacucgaagucccagaucaaccgccaggugaucgucgacucggagaacuggagcggguacuccggcaucuucucgguggaggggaagaacugcaucaaccggugcuucuacguggagcugauccggggccgcccgcaggagccccgcgucugguggaccuccaacucgaucaucguguucugcggcaccuccgggacguacggcaccgggagcuggcccgacggcgccaacaucaacuucaugcccaucuga

SEQ ID NO: 25994 - RNA, 1401 nt, Artificial Sequence
  derived and/or modified CDS sequence (AUadapt) from InfluenzaA__AGQ81815__NA
augaaccccaaccagaagaucaucgccaucggcucggugucccugaccaucgccaucaucugcuuccucaugcagaucgcgauccugaccacgaccaugacccugcacuucaagcagaacgagugcucgaacccguccaacaaccaggucgugcccugcgagcccauccucaucgagcgcaacaccgugcaccugaacucgacgaccaucgagaaggaggucugccccaagguggccgaguacaagaacugguccaagccgcagugccagaucaccggguucgcccccuucagcaaggacaacuccauccggcugucggccggcggggacaucugggugacccgcgagcccuacgucuccugcucgcucggcaagugcuaccaguucgcccuggggcagggcacgacccugaagaacaagcacuccaacggcaccacccacgaccggacgccccaccgcacccuccugaugaacgagcugggggugccguuccaccucggcaccaagcaggucugcaucgcguggucguccagcuccugcuacgacgggaaggccuggcugcacaucugcgugaccggcgacgacaagaacgccacggccucgaucaucuacgacgggaugcugguggacuccaucggcucgugguccaagaacauccuccggacccaggagucggagugcgugugcaucaacgggaccugcgcggucgugaugaccgacggcagcgccuccggcaaggccgacacgcgcauccuguucauccgggaggggaagaucaucaacaucucgccccuguccggcucggcccagcacguggaggagugcuccugcuacccccgcuaccccgagguccggugcgugugccgcgacaacuggaagggcagcaaccggccggugcucuacaucaacauggccgacuacuccgucgagucguccuacgugugcucggggcuggugggcgacacgccccgcaacgacgacuccucguccagcuccaacugccgggaccccaacaacgagcgcgggacccccggcgucaaggggugggcguucgacgacggcaacgacguguggaugggccggaccauccgcaacgacucgcgguccggguacgagaccuuccgcgugaucaacggcuggaccaccgccaacucgaagucccagaucaaccggcaggucaucguggacucggagaacuggagcggguacuccggcaucuucucggucgaggggaagaacugcaucaaccgcugcuucuacguggagcugauccggggccgcccgcaggagccccgcgugugguggaccuccaacucgaucaucgucuucugcggcacguccgggaccuacggcaccgggagcuggcccgacggcgccaacaucaacuacaugcccaucuga

SEQ ID NO: 25995 - RNA, 1401 nt, Artificial Sequence
  derived and/or modified CDS sequence (AUadapt) from InfluenzaA__AGQ81816__NA
augaaccccaaccagaagaucaucgccaucggcucggugucccugaccaucgccaucaucugcuuccucaugcagaucgcgauccugaccacgaccaugacccugcacuucaagcagaacgggugcucgaacccguccaacaaccaggucgugcccugcgagcccauccucaucgagcgcaacaccgugcaccugaacucgacgaccaucgagaaggaggucugccccaagguggccgaguacaagaacugguccaagccgcagugccagaucaccggcuucgcccccuucagcaaggacaacuccauccggcugucggccgggggcgacaucugggugacccgcgagcccuacgucuccugcucgcucgggaagugcuaccaguucgcccugggccagggcacgacccugaagaacaagcacuccaacgggaccacccacgaccggacgccccaccgcacccuccugaugaacgagcugggcgugccguuccaccucgggaccaagcaggucugcaucgcguggucguccagcuccugcuacgacggcaaggccuggcugcacaucugcgugaccggggacgacaagaacgccacggccucgaucaucuacgacggcaugcugguggacuccaucggcucgugguccaagaacauccuccggacccaggagucggagugcgugugcaucaacgggaccugcgcggucgugaugaccgacggcagcgccuccgggaaggccgacacgcgcauccuguucauccgggagggcaagaucaucaacaucucgccccuguccggcucggcccagcacguggaggagugcuccugcuacccccgcuaccccgagguccggugcgugugccgcgacaacuggaaggggagcaaccggccggugcucuacaucaacauggccgacuacuccgucgagucguccuacgugugcucgggccuggugggggacacgccccgcaacgacgacuccucguccagcuccaacugccgggaccccaacaacgagcgcggcacccccggggucaagggcugggcguucgacgacggcaacgacguguggauggggcggaccauccgcaacgacucgcgguccggcuacgagaccuuccgcgugaucaacggguggaccaccgccaacucgaagucccagaucaaccggcaggucaucguggacucggagaacuggagcggcuacuccgggaucuucucggucgagggcaagaacugcaucaaccgcugcuucuacguggagcugauccggggccgcccgcaggagccccgcgugugguggaccuccaacucgaucaucgucuucugcgggacguccggcaccuacgggaccggcagcuggcccgacggggccaacaucaacuacaugcccaucuga

SEQ ID NO: 25996 - RNA, 1401 nt, Artificial Sequence; identical to SEQ ID NO: 25994
  derived and/or modified CDS sequence (AUadapt) from InfluenzaA__AGQ81817__NA

SEQ ID NO: 25997 - RNA, 1401 nt, Artificial Sequence; identical to SEQ ID NO: 25994
  derived and/or modified CDS sequence (AUadapt) from InfluenzaA__AGQ81818__NA

SEQ ID NO: 25998 - RNA, 1401 nt, Artificial Sequence; identical to SEQ ID NO: 25994
  derived and/or modified CDS sequence (AUadapt) from InfluenzaA__AGQ81819__NA

SEQ ID NO: 25999 - RNA, 1401 nt, Artificial Sequence
  derived and/or modified CDS sequence (AUadapt) from InfluenzaA__AGQ81820__NA
augaaccccaaccagaagaucaucgccaucggcucggugucccugaccaucgccaucaucugcuuccucaugcagaucgcgauccugaccacgaccaugacccugcacuucaagcagaacgagugcucgaacccguccaacaaccaggucgugcccugcgagcccauccucaucgagcgcaacaccgugcaccugaacucgacgaccaucgagaaggaggucugccccaagguggccgaguacaagaacugguccaagccgcagugccagaucaccggguucgcccccuucagcaaggacaacuccauccggcugucggccggcggggacaucugggugacccgcgagcccuacgucuccugcucgcucggcaagugcuaccaguucgcccuggggcagggcacgacccugaagaacaagcacuccaacggcaccacccacgaccggacgccccaccgcacccuccugaugaacgagcugggggugccguuccaccucggcaccaagcaggucugcaucgcguggagcuccucguccugcuacgacgggaaggccuggcugcacaucugcgugaccggcgacgacaagaacgccacggccucgaucaucuacgacgggaugcugguggacuccaucggcagcugguccaagaacauccuccggacccaggagucggagugcgugugcaucaacgggaccugcgcggucgugaugaccgacggcucggccuccggcaaggccgacacgcgcauccuguucauccgggaggggaagaucaucaacaucagcccccuguccggcucggcccagcacguggaggagugcuccugcuacccccgcuaccccgagguccggugcgugugccgcgacaacuggaagggcucgaaccggccggugcucuacaucaacauggccgacuacuccaucgagucguccuacgucugcagcgggcuggugggcgacacgccccgcaacgacgacuccucguccucguccaacugccgggaccccaacaacgagcgcgggacccccggcgugaaggggugggcguucgacgacggcaacgacgucuggaugggccggaccauccgcaacgacagccgguccggguacgagaccuuccgcgugaucaacggcuggaccaccgccaacucgaagucccagaucaaccgccaggugaucgucgacucggagaacuggagcggguacuccggcaucuucucgguggaggggaagaacugcaucaaccggugcuucuacgucgagcugauccggggccgcccgcaggagcccaaggugugguggaccuccaacucgaucaucguguucugcggcacguccgggaccuacggcaccgggagcuggcccgacggcgccaacaucaacuucaugcccaucuga

SEQ ID NO: 26000 - RNA, 1401 nt, Artificial Sequence
  derived and/or modified CDS sequence (AUadapt) from InfluenzaA__AGQ81822__NA
augaaccccaaccagaagaucaucgccaucggcucggugucccugaccaucgccaucaucugcuuccucaugcagaucgcgauccugaccacgaccaugacccugcacuucaagcagaacgagugcucgaacccguccaacaaccaggucgugcccugcgagcccauccucaucgagcgcaacaccgugcaccugaacucgacgaccaucgagaagaaggucugccccaagguggccgaguacaagaacugguccaagccgcagugccagaucaccggguucgcccccuucagcaaggacaacuccauccggcugucggccggcggggacaucugggugacccgcgagcccuacgucuccugcucgcucggcaagugcuaccaguucgcccuggggcagggcacgacccugaagaacaagcacuccaacggcaccacccacgaccggacgccccaccgcacccuccugaugaacgagcugggggugccguuccaccucggcaccaagcaggucugcaucgcguggucguccagcuccugcuacgacgggaaggccuggcugcacaucugcgugaccggcgacgacaagaacgccacggccucgaucaucuacgacgggaugcugguggacuccaucggcucgugguccaagaacauccuccggacccaggagucggagugcgugugcaucaacgggaccugcgcggucgugaugaccgacggcagcgccuccggcaaggccgacacgcgcauccuguucauccgggaggggaagaucaucaacaucucgccccuguccggcucggcccagcacguggaggagugcuccugcuacccccgcuaccccgagguccggugcgugugccgcgacaacuggaagggcagcaaccggccggugcucuacaucaacauggccgacuacuccgucgagucguccuacgugugcucggggcuggugggcgacacgccccgcaacgacgacuccucguccagcuccaacugccgggaccccaacaacgagcgcgggacccccggcgucaaggggugggcguucgacgacggcaacgacguguggaugggccggaccauccgcaacgacucgcgguccggguacgagaccuuccgcgugaucaacggcuggaccaccgccaacucgaagucccagaucaaccggcaggucaucguggacucggagaacuggagcggguacuccggcaucuucucggucgaggggaagaacugcaucaaccgcugcuucuacguggagcugauccggggccgcccgcaggagccccgcgugugguggaccuccaacucgaucaucgucuucugcggcacguccgggaccuacggcaccgggagcuggcccgacggcgccaacaucaacuacaugcccaucuga

SEQ ID NO: 26001 - RNA, 1401 nt, Artificial Sequence
  derived and/or modified CDS sequence (AUadapt) from InfluenzaA__AGQ81823__NA
augaaccccaaccagaagaucaucgccaucggcucggugucccugaccaucgccaucaucugcuuccucaugcagaucgcgauccugaccacgaccaugacccugcacuucaagcagaacgagugcucgaacccguccaacaaccaggucgugcccugcgagcccauccucaucgagcgcaacaccgugcaccugaacucgacgaccaucgagaaggaggucugccccaagguggccgaguacaagaacugguccaagccgcagugccagaucaccggguucgcccccuucagcaaggacaacuccauccggcugucggccggcggggacaucugggugacccgcgagcccuacgucuccugcucgcucggcaagugcuaccaguucgcccuggggcagggcacgacccugaagaacaagcacuccaacggcaccacccacgaccggacgccccaccgcacccuccugaugaacgagcugggggugccguuccaccucggcaccaagcaggucugcaucgcguggagcuccucguccugcuacgacgggaaggccuggcugcacaucugcgugaccggcgacgacaagaacgccacggccucgaucaucuacgacgggaugcugguggacuccaucggcagcugguccaagaacauccuccggacccaggagucggagugcgugugcaucaacgggaccugcgcggucgugaugaccgacggcucggccuccggcaaggccgacacgcgcauccuguucauccgggaggggaagaucaucaacaucagcccccuguccggcucggcccagcacguggaggagugcuccugcuacccccgcuaccccgagguccggugcgugugccgcgacaacuggaagggcucgaaccggccggugcucuacaucaacauggccgacuacuccgucgagucguccuacgugugcagcgggcuggugggcgacacgccccgcaacgacgacuccucguccucguccaacugccgggaccccaacaacgagcgcggggcgcccggcgucaaggggugggccuucgacgacggcaacgacguguggaugggccggaccauccgcaacgacagccgguccggguacgagaccuuccgcguggucaacggcuggaccaccgccaacucgaagucccagaucaaccgccaggugaucgucgacucggagaacuggagcggguacuccggcaucuucucgguggaggggaagaacugcaucaaccggugcuucuacguggagcugauccggggccgcccgcaggagccccgcgucugguggaccuccaacucgaucaucguguucugcggcaccuccgggacguacggcaccgggagcuggcccgacggcgccaacaucaacuucaugcccaucuga

SEQ ID NO: 26002 - RNA, 1401 nt, Artificial Sequence; identical to SEQ ID NO: 26001
  derived and/or modified CDS sequence (AUadapt) from InfluenzaA__AGQ81824__NA

SEQ ID NO: 26003 - RNA, 1401 nt, Artificial Sequence; identical to SEQ ID NO: 26001
  derived and/or modified CDS sequence (AUadapt) from InfluenzaA__AGQ81825__NA

SEQ ID NO: 26004 - RNA, 1401 nt, Artificial Sequence
  derived and/or modified CDS sequence (AUadapt) from InfluenzaA__AGQ81831__NA
augaaccccaaccagaagauccuggccaucggcucggugucccucaccaucgccaucaucugcuuccugaugcagaucgcgauccugaccacgaccaugacccuccacuucaagcagaacgagugcucgaacccguccaacaaccaggucgugcccugcgagcccauccugaucgagcgcaacaccgugcaccugaacagcacgaccaucgagaaggaggucugccccaagguggccgaguacaagaacugguccaagccgcagugccagaucaccggguucgcccccuucucgaaggacaacuccauccggcucucggccggcggggacaucugggugacccgcgagcccuacgucuccugcagccugggcaagugcuaccaguucgcccuggggcagggcacgacccucaagaacaagcacuccaacggcaccacccacgaccggacgccccaccgcacccugcugaugaacgagcucggggugccguuccaccugggcaccaagcaggucugcaucgcguggucguccagcuccugcuacgacgggaaggccuggcugcacaucugcgugaccggcgacgacaagaacgccacggccucgaucaucuacgacgggaugcucguggacuccaucggcucgugguccaagaacauccugcggacccaggagagcgagugcgugugcaucaacgggaccugcgcggucgugaugaccgacggcucggccuccggcaaggccgacacgcgcauccuguucauccgggaggggaagaucgugaacaucagcccccucuccggcucggcccagcacgucgaggagugcuccugcuacccccgcuaccccgaggugcggugcgugugccgcgacaacuggaagggcucgaaccggccgguccuguacaucaacauggccgacuacuccguggagagcuccuacgugugcucggggcuggucggcgacacgccccgcaacgacgacuccuucucguccagcaacugccgggaccccaacaacgagcgcggggcgcccggcgugaaggggugggccuucgacgacggcaacgacguguggaugggccggaccauccgcaacgacucccggucgggguacgagaccuuccgcgucgugaacggcuggaccaccgccaacuccaagagccagaucaaccggcaggucaucguggacuccgagucguggucgggguacuccggcaucuucagcguggaggggaagaacugcaucaaccgcugcuucuacgucgagcucauccggggccgcccgcaggagccccgcgugugguggaccuccaacucgaucaucguguucugcggcaccuccgggacguacggcaccgggagcuggcccgacggcgccaacaucaacuucaugcccaucuga

SEQ ID NO: 26005 - RNA, 1401 nt, Artificial Sequence; identical to SEQ ID NO: 25994
  derived and/or modified CDS sequence (AUadapt) from InfluenzaA__AGQ81837__NA

SEQ ID NO: 26006 - RNA, 1401 nt, Artificial Sequence; identical to SEQ ID NO: 25994
  derived and/or modified CDS sequence (AUadapt) from InfluenzaA__AGQ81838__NA

SEQ ID NO: 26007 - RNA, 1401 nt, Artificial Sequence; identical to SEQ ID NO: 26001
  derived and/or modified CDS sequence (AUadapt) from InfluenzaA__AGQ81839__NA

SEQ ID NO: 26008 - RNA, 1401 nt, Artificial Sequence; identical to SEQ ID NO: 26001
  derived and/or modified CDS sequence (AUadapt) from InfluenzaA__AGQ81840__NA

SEQ ID NO: 26009 - RNA, 1401 nt, Artificial Sequence; identical to SEQ ID NO: 25994
  derived and/or modified CDS sequence (AUadapt) from InfluenzaA__AGQ81841__NA

SEQ ID NO: 26010 - RNA, 1410 nt, Artificial Sequence
  derived and/or modified CDS sequence (AUadapt) from InfluenzaA__AGQ81843__NA
augaaccccaaccagaagaucaucaccaucggcguggucaacaccacgcugucgaccaucgcccuccugaucgggaucggcaaccugaucuucaacaccgugauccacgagaagaucggggugcaccagaccgucguguacccgacgaucaccccgcccgugauccccaacugcuccgacaccaccaucacguacaacaacaccgucgugaacaacaucaccaccacgaucaucaacaaggccgagaagcaguucaagcccucgcucccccugugccccuuccgcggcuucuuccccuuccacaaggacaacgcgauccggcugggggagaacaaggacgugaucgucacccgcgagccguacguguccugcgacaacgacgacugcuggucguucgcccucgcccagggcgcccugcugggcaccaagcacuccaacgggaccaucaaggaccggacgcccuaccgcucgcucauccgguuccccaucggcaccgcccccgugcuggggaacuacaaggagaucugcgucgcgugguccucguccucgugcuucgacggcaaggaguggaugcacgugugcaugaccgggaacgacaacgacgccuccggccagaucaucuacgccggcaagaugaccgacagcaucaaguccuggcgccgggacauccugcgcacgcaggagucggagugccagugcaucgacgggaccugcaucguggccgucaccgacggcccggcggccuccucggccgaccaccggaucuacuggauccgcgaggggaagaucaucaaguacgaggacauccccaagaccaagauccagcaccucgaggagugcuccugcuacguggacacggacguguacugcaucugccgggacaacuggaagggcucgaaccgccccuggaugcggaucaacaacgagaccauccuggagaccggcuacgucugcuccaaguuccacucggacacgccccgcccggccgaccccucgaccguguccugcgacucgcccuccaacaucaacgggggccccggggugaagggcuucggguuccgggccggcaacgacgucuggcugggccgcaccgugagcaccaccgggcgguccggcuucgaggugaucaaggucacggagggguggaucaacucgcucaaccacgcgaaguccgugacccagacccuggucucgaacaacgacugguccggcuacucgggguccuucaucguggagaacaacggcugcuuccagccgugcuucuacaucgagcugauccgcggccggcccaaccgcaacgacgacgugucguggaccuccaacucgaucgucacguucugcgggcucgacaacgagcccggcuccgggaacuggcccgacggcagcaacaucggguucaugccgaaguga

SEQ ID NO: 26011 - RNA, 1410 nt, Artificial Sequence
  derived and/or modified CDS sequence (AUadapt) from InfluenzaA__AGQ81845__NA
augaaccccaaccagaagaucaucaccaucggcguggucaacaccacgcugucgaccaucgcccuccugaucgggaucggcaaccugaucuucaacaccgugauccacgagaagaucggggugcaccagaccgucaucuacccgacgaucaccucccccguggugcccaacugcucggacaccaccaucacguacaacaacaccgucgugaacaacaucaccaccacggugaucaacaaggccgagaagcacuucaagcccucccucccgcugugccccuucaagggcuucuuccccuuccacaaggacaacgcgauccgccugggggagaacaaggacgucaucgugacccgggagcccuacgugucgugcgacaacgacgacugcugguccuucgcccucgcccagggcgcccugcugggcaccaagcacucgaacgggaccaucaaggaccgcacgccguaccggucccucauccgcuuccccaucggcaccgcccccguccuggggaacuacaaggagaucugcguggcguggagcuccucguccugcuucgacggcaaggaguggaugcacgugugcaugaccgggaacgacaacgacgccucgggccagaucaucuacgccggcaagaugaccgacuccaucaagucguggcggcgcgacauccugcggacgcaggaguccgagugccagugcaucgacgggaccugcaucgucgccgugaccgacggccccgcggccaacucggccgaccaccgcaucuacuggauccgggaggggaagaucaucaaguacgagaacaucccgaagaccaagauccagcaccucgaggagugcuccugcuacguggacacggacgucuacugcaucugccgcgacaacuggaagggcagcaaccggcccuggaugcgcaucaacaacgagaccauccuggagaccggcuacgugugcuccaaguuccacucggacacgccccggcccgccgacccgucgaccguguccugcgacucgcccuccaacaucaacgggggccccggggucaagggcuucggguuccgcaccggcaacgacguguggcugggccggaccgugucgaccacggggcgcuccggcuucgaggucaucaaggugaccgagggguggaucaacagccucaaccacgccaaguccgucacccagacccuggugucgaacuccgacuggucgggcuacuccgggucguucaucguggagaacaacggcugcuuccagcccugcuucuacaucgagcugauccggggccgcccgaacaagaacgacgacgucuccuggacgucgaacuccaucgugaccuucugcgggcucgacaacgagcccggcagcgggaacuggcccgacggcuccaacaucggguucaugcccaaguga

SEQ ID NO: 26012 - RNA, 1410 nt, Artificial Sequence; identical to SEQ ID NO: 26011
  derived and/or modified CDS sequence (AUadapt) from InfluenzaA__AGQ81846__NA

SEQ ID NO: 26013 - RNA, 1410 nt, Artificial Sequence; identical to SEQ ID NO: 26011
  derived and/or modified CDS sequence (AUadapt) from InfluenzaA__AGQ81847__NA

SEQ ID NO: 26014 - RNA, 1410 nt, Artificial Sequence
  derived and/or modified CDS sequence (AUadapt) from InfluenzaA__AGQ81848__NA
augaaccccaaccagaagaucaucaccaucggcguggucaacaccacgcugucgaccaucgcccuccugaucgggaucggcaaccugaucuucaacaccgugauccacgagaagaucggggugcaccagaccgucaucuacccgacgaucaccucccccguggugcccaacugcucggacaccaccaucacguacaacaacaccgucgugaacaacaucaccaccacggugaucaacaaggccgagaagcacuucaagcccucccucccgcugugccccuucaagggcuucuuccccuuccacaaggacaacgcgauccgccugggggagaacaaggacgucaucgugacccgggagcccuacgugucgugcgacaacgacgacugcugguccuucgcccucgcccagggcgcccugcugggcaccaagcacagcaacgggaccaucaaggaccgcacgccguaccggucccucauccgcuuccccaucggcaccgcccccguccuggggaacuacaaggagaucugcguggcguggucguccucguccugcuucgacggcaaggaguggaugcacgugugcaugaccgggaacgacaacgacgccucgggccagaucaucuacgccggcaagaugaccgacuccaucaagagcuggcggcgcgacauccugcggacgcaggaguccgagugccagugcaucgacgggaucugcaucgucgccgugaccgacggccccgcggccaacucggccgaccaccgcaucuacuggauccgggaggggaagaucaucaaguacgagaacaucccgaagaccaagauccagcaccucgaggagugcuccugcuacguggacaccgacgucuacugcaucugccgcgacaacuggaagggcucgaaccggcccuggaugcgcaucaacaacgagacgauccuggagaccggcuacgugugcuccaaguuccacucggacacgccccggcccgccgacccgagcaccguguccugcgacucgcccuccaacaucaacgggggccccggggucaagggcuucggguuccgcaccggcaacgacguguggcugggccggaccgugucgaccaccgggcgcuccggcuucgaggucaucaaggugacggagggguggaucaacucgcucaaccacgccaaguccgucacccagacccuggugagcaacuccgacuggucgggcuacuccgggucguucaucguggagaacaacggcugcuuccagcccugcuucuacaucgagcugauccggggccgcccgaacaagaacgacgacgucuccuggaccucgaacuccaucgugacguucugcgggcucgacaacgagcccggcagcgggaacuggcccgacggcuccaacaucggguucaugcccaaguga

SEQ ID NO: 26015 - RNA, 1410 nt, Artificial Sequence
  derived and/or modified CDS sequence (AUadapt) from InfluenzaA__AGQ81850__NA
augaaccccaaccagaagaucaucaccaucggcguggucaacaccacgcugucgaccaucgcccuccugaucgggaucggcaaccugaucuucaacaccgugauccacgagaagaucggggugcaccagaccgucaucuacccgacgaucaccucccccguggugcccaacugcucggacaccaccaucacguacaacaacaccgucgugaacaacaucaccaccacggugaucaacaaggccgagaagcacuucaagcccucccucccgcugugccccuucaagggcuucuuccccuuccacaaggacaacgcgauccgccugggggagaacaaggacgucaucgugacccgggagcccuacgugucgugcgacaacgacgacugcugguccuucgcccucgcccagggcgcccugcugggcaccaagcacucgaacgggaccaucaaggaccgcacgccguaccggucccucauccgcuuccccaucggcaccgcccccguccuggggaacuacaaggagaucugcguggcguggucguccucguccugcuucgacggcaaggaguggaugcacgugugcaugaccgggaacgacaacgacgccaccggccagaucaucuacgccggcaagaugacggacagcaucaaguccuggcggcgcgacauccugcggacccaggagucggagugccagugcaucgacgggaccugcaucgucgccgugaccgacggccccgcggccaacuccgccgaccaccgcaucuacuggauccgggaggggaagaucaucaaguacgagaacaucccgaagacgaagauccagcaccucgaggagugcucgugcuacguggacaccgacgucuacugcaucugccgcgacaacuggaagggcuccaaccggcccuggaugcgcaucaacaacgagaccauccuggagaccggcuacgugugcucgaaguuccacuccgacacgccccggcccgccgacccgucgaccgugucgugcgacucccccucgaacaucaacgggggccccggggucaagggcuucggguuccgcaccggcaacgacguguggcugggccggaccguguccacgaccgggcgcagcggcuucgaggucaucaaggugaccgagggguggaucaacucccucaaccacgccaagucggucacccagacgcugguguccaacucggacugguccggcuacucgggguccuucaucguggagaacaacggcugcuuccagcccugcuucuacaucgagcugauccggggccgcccgaacaagaacgacgacgucucguggaccuccaacucgaucgugaccuucugcgggcucgacaacgagcccggcuccgggaacuggcccgacggcagcaacaucggguucaugcccaaguga

SEQ ID NO: 26016 - RNA, 1410 nt, Artificial Sequence
  derived and/or modified CDS sequence (AUadapt) from InfluenzaA__AGQ81852__NA
augaaccccaaccagaagaucaucaccaucggcguggucaacaccacgcugucgaccaucgcccuccugaucgggaucggcaaccugaucuucaacaccgugauccacgagaagaucggggugcaccagaccgucacguacccgaccaucaccucccccguggugcccaacugcucggacaccacgaucaccuacaacaacaccgucgugaacaacaucaccacgaccgugaucaacaaggccgagaagcacuucaagcccucccucccgcugugccccuucaagggcuucuuccccuuccacaaggacaacgcgauccgccugggggagaacaaggacgucaucgugacccgggagcccuacgugucgugcgacaacgacgacugcugguccuucgcccucgcccagggcgcccugcugggcaccaagcacucgaacgggacgaucaaggaccgcaccccguaccggucccucauccgcuuccccaucggcaccgcccccguccuggggaacuacaaggagaucugcguggcguggucguccucguccugcuucgacggcaaggaguggaugcacgugugcaugaccgggaacgacaacgacgccacgggccagaucaucuacgccggcaagaugaccgacucgaucaaguccuggcggcgcgacauccugcggacccaggagucggagugccagugcaucgacgggaccugcaucgucgccgugacggacggccccgcggccaacuccgccgaccaccgcaucuacuggauccgggaggggaagaucaucaaguacgagaacaucccgaagaccaagauccagcaccucgaggagugcucgugcuacguggacaccgacgucuacugcaucugccgcgacaacuggaagggcuccaaccggcccuggaugcgcaucaacaacgagaccauccuggagacgggcuacgugugcagcaaguuccacuccgacacgccccggcccgccgacccgucgaccgugucgugcgacucccccucgaacaucaacgggggccccggggucaagggcuucggguuccgcaccggcaacgacguguggcugggccggaccguguccaccaccgggcgcucgggcuucgaggucaucaaggugaccgagggguggaucaacucccucaaccacgccaagucggucacgcagacccugguguccaacucggacugguccggcuacucgggguccuucaucguggagaacaacggcugcuuccagcccugcuucuacaucgagcugauccggggccgcccgaaccggaacgacgacgucucguggaccuccaacucgaucgugaccuucugcgggcucgacaacgagcccggcuccgggaacuggcccgacggcagcaacaucggguucaugcccaaguga

SEQ ID NO: 26017 - RNA, 1410 nt, Artificial Sequence
  derived and/or modified CDS sequence (AUadapt) from InfluenzaA__AGQ81853__NA
augaaccccaaccagaagaucaucaccaucggcguggucaacaccacgcugucgaccaucgcccuccugaucgggaucggcaaccugaucuucaacaccgugauccacgagaagaucggggugcaccagaccgucacguacccgaccaucaccucccccguggugcccaacugcucggacaccacgaucaccuacaacaacaccgucgugaacaacaucaccacgaccgugaucaacaaggccgagaagcacuucaagcccucccucccgcugugccccuucaagggcuucuuccccuuccacaaggacaacgcgauccgccugggggagaacaaggacgucaucgugacccgggagcccuacgugucgugcgacaacgacgacugcugguccuucgcccucgcccagggcgcccugcugggcaccaagcacucgaacgggacgaucaaggaccgcaccccguaccggucccucauccgcuuccccaucggcaccgcccccguccuggggaacuacaaggagaucugcguggcguggucguccucguccugcuucgacggcaaggaguggaugcacgugugcaugaccgggaacgacaacgacgccacgggccagaucaucuacgccggcaagaugaccgacucgaucaaguccuggcggcgcgacauccugcggacccaggagucggagugccagugcaucgacgggaccugcaucgucgccgugacggacggccccgcggccaacuccgccgaccaccgcaucuacuggauccgggaggggaagaucaucaaguacgagaacaucccgaagaccaagauccagcaccucgaggagugcucgugcuacguggacaccgacgucuacugcaucugccgcgacaacuggaagggcuccaaccggcccuggaugcgcaucaacaacgagaccauccuggagacgggcuacgugugcagcaaguuccacuccgacacgccccggcccgccgacccgucgaccgugucgugcgacucccccucgaacaucaacgggggccccggggucaagggcuucggguuccgcaccggcaacgacguguggcugggccggaccguguccaccaccgggcgcucgggcuucgaggucaucaaggugaccgagggguggaucaacucccucaaccacgccaagucggucacgcagacccugguguccaacucggacugguccggcuacucgggguccuucaucguggagaacaacggcugcuuccagcccugcuucuacaucgagcugauccggggccgcccgaacaagaacgacgacgucucguggaccuccaacucgaucgugaccuucugcgggcucgacaacgagcccggcuccgggaacuggcccgacggcagcaacaucggguucaugcccaaguga

SEQ ID NO: 26018 - RNA, 1410 nt, Artificial Sequence; identical to SEQ ID NO: 26017
  derived and/or modified CDS sequence (AUadapt) from InfluenzaA__AGQ81854__NA

SEQ ID NO: 26019 - RNA, 1410 nt, Artificial Sequence; identical to SEQ ID NO: 26017
  derived and/or modified CDS sequence (AUadapt) from InfluenzaA__AGQ81855__NA

SEQ ID NO: 26020 - RNA, 1410 nt, Artificial Sequence; identical to SEQ ID NO: 26010
  derived and/or modified CDS sequence (AUadapt) from InfluenzaA__AGQ81856__NA

SEQ ID NO: 26021 - RNA, 1410 nt, Artificial Sequence
  derived and/or modified CDS sequence (AUadapt) from InfluenzaA__AGQ81857__NA
augaaccccaaccagaagaucaucaccaucggcguggucaacaccacgcugucgaccaucgcccuccugaucgggaucggcaaccugaucuucaacaccgugauccacgagaagaucggggugcaccagaccgucguguacccgacgaucaccccgcccgugauccccaacugcuccgacaccaccaucacguacaacaacaccgucgugaacaacaucaccaccacgaucaucaacaaggccgagaagcaguucaagcccucgcucccccugugccccuuccgcggcuucuuccccuuccacaaggacaacgcgauccggcugggggagaacaaggacgugaucgucacccgcgagccguacguguccugcgacaacgacgacugcuggucguucgcccucgcccagggcgcccugcugggcaccaagcacuccaacgggaccaucaaggaccggacgcccuaccgcucgcucauccgguuccccaucggcaccgcccccgugcuggggaacuacaaggagaucugcgucgcgugguccagcuccucgugcuucgacggcaaggaguggaugcacgugugcaugaccgggaacgacaacgacgccuccggccagaucaucuacgccggcaagaugaccgacucgaucaaguccuggcgccgggacauccugcgcacgcaggagucggagugccagugcaucgacgggaccugcaucguggccgucaccgacggcccggcggccuccucggccgaccaccggaucuacuggauccgcgaggggaagaucaucaaguacgaggacauccccaagaccaagauccagcaccucgaggagugcuccugcuacguggacacggacguguacugcaucugccgggacaacuggaagggcagcaaccgccccuggaugcggaucaacaacgagaccauccuggagaccggcuacgucugcuccaaguuccacucggacacgccccgcccggccgaccccucgaccguguccugcgacucgcccuccaacaucaacgggggccccggggugaagggcuucggguuccgggccggcaacgacgucuggcugggccgcaccgugucgaccaccgggcgguccggcuucgaggugaucaaggucacggagggguggaucaacagccucaaccacgcgaaguccgugacccagacccuggucucgaacaacgacugguccggcuacucgggguccuucaucguggagucgaacggcugcuuccagccgugcuucuacaucgagcugauccgcggccggcccaaccgcaacgacgacguguccuggaccucgaacuccaucgucacguucugcgggcucgacaacgagcccggcagcgggaacuggcccgacggcuccaacaucggguucaugccgaaguga

SEQ ID NO: 26022 - RNA, 1410 nt, Artificial Sequence
  derived and/or modified CDS sequence (AUadapt) from InfluenzaA__AGQ81858__NA
augaaccccaaccagaagaucaucaccaucggcguggucaacaccacgcugucgaccaucgcccuccugaucggggugggcaaccugaucuucaacaccgugauccacgagaagaucggggaccaccagaucgucguguacccgaccacgaccgccuccgugguccccaacugcucggacaccaucaucaccuacaacaacacgguggugaacaacaucaccaccaccaucaucacgaaggaggagacccacuucaaguccucgcucccccugugccccuuccgcggcuucuucccguuccacaaggacaacgcgauccggcugggggagaacaaggacgucaucgugacccgcgagcccuacguguccugcgacaacgacgacugcuggucguucgcccucgcccagggcgcccugcugggcaccaagcacuccaacgggacgaucaaggaccggacccccuaccgcagccucauccgguuccccaucggcaccgccccgguccuggggaacuacaaggagaucugcguggcgugguccucguccucgugcuucgacggcaaggaguggaugcacgugugcaugaccgggaacgacaacgacgccuccggccagaucauguacgccggcaagaugacggacucgaucaaguccuggcgcaaggacauccugcggacccaggagagcgagugccagugcaucgacgggaccugcaucgucgccgugaccgacggccccgcgacgaacuccgccgaccaccgcaucuacuggauccgggaggggaagaucaucaaguacgagaacauccccaagaccaagauccagcaccucgaggagugcucgugcuacguggacaucgacgucuacugcgugugccgcgacaacuggaagggcuccaaccggcccuggaugcgcaucaacaacgagaccauccuggagaccggcuacgugugcucgaaguuccacucggacacgccgcggcccgccgaccccuccaccgucagcugcgacucccccucgaacgugaacgggggcccgggggugaagggcuucggguucaagaccggcaacgacgucuggcugggccgcaccguguccacgucggggcgguccggcuucgagaucaucaaggucaccgagggguggaucaacucgcccaaccacgccaaguccgugacccagacccucgugagcaacaacgacugguccggcuacucgggguccuucaucgucgagaacaacggcugcuuccagcccugcuucuacaucgagcugauccgcggccggcccaacaagaacgacgacgugucguggacguccaacucgaucgugaccuucugcgggcuggacaacgagccgggcuccgggaacuggcccgacggcagcaacaucggguucaugcccaaguga

SEQ ID NO: 26023 - RNA, 1410 nt, Artificial Sequence
  derived and/or modified CDS sequence (AUadapt) from InfluenzaA__AGQ81859__NA
augaaccccaaccagaagaucaucaccaucggcguggucaacaccacgcugucgaccaucgcgcuccugaucgggaucggcaaccugaucuucaacaccgugauccacgagaagaucggggugcaccagaccgucgugugcccgacgaucaccccgcccgugguccccaacugcuccgacaccaccaucacguacaacaacaccguggugaacaacaucaccaccacgaucaucaacaaggccgagaagcaguucaagucgucccucccccugugccccuuccgcggcuucuuccccuuccacaaggacaacgcgauccggcugggggagaacaaggacgucaucgugacccgcgagcccuacgugucgugcgacaacgacgacugcugguccuucgcccucgcccagggcgcccugcugggcaccaagcacagcaacgggaccaucaaggaccggacgccguaccgcucccucauccgguuccccaucggcaccgcccccguccuggggaacuacaaggagaucugcguggcguggucguccucguccugcuucgacggcaaggaguggaugcacaucugcaugaccgggaacgacaacgacgccagcggccagaucaucuacgccggcaagaugaccgacuccaucaagucguggcgccgggacauccugcgcacgcaggaguccgagugccagugcaucgacgggaccugcaucguggccaucaccgacggccccgcggccucguccgccgaccaccggaucuacuggauccgcgaggggaagaucaucaaguacgagaacaucccgaagaccaagauccagcaccucgaggagugcucgugcuacgucgacaucgacguguacugcaucugccgggacaacuggaagggcuccaaccgccccuggaugcggaucaacaacgagacgauccuggagaccggcuacgugugcagcaaguuccacucggacacgccccgccccgccgacccguccaccgucucgugcgacucccccagcaacaucaacgggggccccggggugaagggcuucggguuccgggccggcaacgacguguggcugggccgcaccgucuccaccaccgggcggucgggcuucgaggugaucaaggugaccgagggguggaucaacucccucaaccacgccaagucggucacgcagacccugguguccaacucggacugguccggcuacagcggguccuucaucgucgagaacaacggcugcuuccagcccugcuucuacaucgagcugauccgcggccggccgaaccgcaacgacgacgugucguggaccuccaacucgaucgugaccuucugcgggcucgacaacgagcccggcuccgggaacuggcccgacggcagcaacaucggguucaugcccaaguga

SEQ ID NO: 26024 - RNA, 1413 nt, Artificial Sequence
  derived and/or modified CDS sequence (AUadapt) from InfluenzaA__AGQ81860__NA
augaaucccaaccagaagaucaucugcaucucggccaccggcaugacccuguccguggucucgcuccugaucgggaucgccaaccugggccucaacaucgggcugcacuacaaggugggcgacacgccggacguguccauccccaacaugaacgagaccaacucgaccaccacgaucaucaacaacaacacccagaacaacuucaccaacaucaccaacaucaucgucaacaagaacgaggagaagacguuccugaaucucaccaagccccugugcgaggugaacuccuggcacauccugucgaaggacaacgcgauccgcaucggggaggacgcccacauccucgugacccgggagcccuaccuguccugcgacccgcagggcugccgcauguucgcccugucgcagggcaccacgcuccgggggcgccacgccaacggcaccauccacgaccggucccccuuccgcgcccuggucucgugggagauggggcaggcgcccucccccuacaacgugaagguggagugcgucggcuggucguccaccucgugccaugacgggaucucccggaugucgaucugcauguccggcccgaacaacaacgccucggccguggugugguacggcgggcgccccgucaccgagauccccuccugggccggcaacauccugcggacgcaggagucggagugcgugugccacaaggggaucugccccguggucaugaccgacggcccggcgaacaaccgcgccgccaccaagaucaucuacuucaaggagggcaagauccagaagaucgaggagcucgccgggucggcccagcacaucgaggagugcuccugcuacggcgcgguggaggugaucaagugcaucugccgggauaacuggaagggggccaaccgccccgucaucaccaucaaccccgagaugaugacgcacaccucgaaguaccugugcuccaaggugcugaccgacaccucgcggcccaacgacccgacgaacggcaacugcgacgcccccaucaccgggggcucccccgaccccggcgugaagggguucgccuuccucgacggcgagaacucguggcuggggcgcaccaucuccaaggacucgcgguccggcuacgagaugcugaaggucccgaacgccgagaccgacacgcagagugggcccaccucccaccaggugaucgugaacaaccagaacuggucgggcuacuccggcgcguucaucgacuacugggccaacaaggagugcuucaaccccugcuucuacgucgagcucauccgcgggcggcccaaggagucguccgugcuguggaccucgaacuccaucgucgcccugugcggcucgaaggagcgccucggguccuggucguggcacgacggcgccgagaucaucuacuucaaguga

SEQ ID NO: 26025 - RNA, 1413 nt, Artificial Sequence
  derived and/or modified CDS sequence (AUadapt) from InfluenzaA__AGQ81861__NA
augaaucccaaccagaagaucaucugcaucucggccaccggcaugacccuguccguggucucgcuccugaucgggaucgccaaccugggccucaacaucgggcugcacuacaaggugggcgacacgccggacguguccauccccaacaugaacgagaccaacucgaccaccacgaucaucaacaacaacacccagaacaacuucaccaacaccacgaauaucaucgucaacaagaacgaggagaagaccuuccugaaccucaccaagccccugugcgaggugaacuccuggcacauccugucgaaggacaacgcgauccgcaucggggaggacgcccacauccucgugacccgggagcccuaccuguccugcgacccgcagggcugccgcauguucgcccugucgcagggcacgacccuccgggggcgccacgccaacggcaccauccacgaucggucccccuuccgcgcccuggucucgugggagauggggcaggcgcccucccccuacaacgugaagguggagugcgucggcuggucguccaccucgugccacgacgggaucucccggaugucgaucugcauguccggcccgaacaacaacgccucggccguggugugguacggcgggcgccccgucacggagauccccuccugggccggcaacauccugcggacccaggagucggagugcgugugccacaaggggaucugucccguggucaugaccgacggcccggcgaacaaccgcgccgccaccaagaucaucuacuucaaggagggcaagauccagaagaucgaggagcucgccgggucggcccagcacaucgaggagugcuccugcuacggcgcgguggaggugaucaagugcaucugccgggacaacuggaagggggccaaccgccccgucaucacgaucaaccccgagaugaugacccacaccucgaaguaccugugcuccaaggugcugaccgacacgagucggcccaacgacccgaccaacggcaacugcgacgcccccaucaccgggggcucccccgaccccggcgugaagggguucgccuuccucgacggcgagaacucguggcuggggcgcaccaucuccaaggacucgcgguccggcuacgagaugcugaaggucccgaacgccgagacggacacccagucggggcccaccucccaccaggugaucgugaacaaccagaauuggucgggcuacuccggcgcguucaucgacuacugggccaacaaggagugcuucaaccccugcuucuacgucgagcucauccgcgggcggcccaaggagucguccgugcuguggaccucgaacuccaucgucgcccugugcggcucgaaggagcgccucggguccuggucguggcacgacggcgccgagaucaucuacuucaaguga

SEQ ID NO: 26026 - RNA, 1413 nt, Artificial Sequence
  derived and/or modified CDS sequence (AUadapt) from InfluenzaA__AGQ81862__NA
augaaucccaaccagaagaucaucugcaucucggccaccggcaugacccuguccguggucucgcuccugaucgggaucgccaaccugggccucaacaucgggcugcacuacaaggugggcgacacgccggacgugaacauccccuccaugaacgagaccaacucgaccaccacgaucaucaacaacaacacccagaacaacuucaccaacaucaccaacaucaucgucaacaaggaggaggggcgcacguuccugaaccucaccaagccccugugugaggugaacuccuggcacauccugucgaaggacaacgcgauccggaucggcgaggacgcccacauccucgugacccgcgagcccuaccuguccugcgacccgcagggcugccggauguucgcccugucgcaggggaccacgcuccgcggccggcacgccaacgggaccauccacgaccgcucccccuuccgggcccuggucucgugggagaugggccaggcgcccucccccuacaacgugcgcguggagugcaucggguggucguccaccucgugccacgauggcaucucccggaugucgaucugcauguccggcccgaacaacaacgccucggccgucgugugguacgggggccgccccgugaccgagauccccuccugggccgggaacauccugcggacgcaggagucggagugcgucugccacaagggcaucugccccguggugaugaccgacggcccggcgaacaaccgcgccgccaccaagaucaucuacuucaaggaggggaagauccagaagaucgaggagcucgagggcaacgcccagcacaucgaggagugcucgugcuacggggccgcgggcgucaucaagugcaucugucgggacaacuggaagggggccaaccgccccgugaucaucaucgaccccgagaugaugacccacacguccaaguaccugugcucgcgggugcugaccgacaccucccgccccaacgacccgaccucgggcaacugcgacgcccccaucacgggcgggucccccgaccccggcgucaagggguucgccuuccucgacggcgagaacucguggcuggggcggaccaucuccaaggacucgcgcuccggcuacgagaugcugaaggugccgaacgccgagaccgacacccagaguggccccacgucccaccaggugaucgucaacaaccagaacuggucgggguacuccggcgcguucaucgacuacugggccaacaaggagugcuucaaccccugcuucuacguggagcucauccgggggcgccccaaggagucguccgugcuguggaccucgaacuccaucgucgcccugugcggcucgaaggagcggcucggguccuggucguggcacgacggcgccgagaucaucuacuucaaguga

SEQ ID NO: 26027 - RNA, 1413 nt, Artificial Sequence
  derived and/or modified CDS sequence (AUadapt) from InfluenzaA__AGQ81863__NA
augaaucccaaccagaagaucaucugcaucucggccaccggcaugacccuguccguggucucgcuccugaucgggaucgccaaccugggccucaacaucgggcugcacuacaaggugggcgacacgccggacgugaacauccccuccaugaacgagaccaacucgaccaccacgaucaucaacaacaacacccagaacaacuucaccaacaucaccaacaucaucgucaacaaggaggaggagcgcacguuccugaaccucaccaagccccugugcgaggugaacuccuggcacauccugucgaaggacaacgcgauccggaucggggaggacgcccauauccucgugacccgcgagcccuaccuguccugcgacccgcagggcugccggauguucgcccugucgcagggcaccacgcuccgcgggcggcacgccaacggcaccauccacgaccgcucccccuuccgggcccuggucucgugggagauggggcaggcgcccucccccuacaacgugcgcguggagugcaucggcuggucguccaccucgugccacgacgggaucucccggaugucgaucugcauguccggcccgaacaacaacgccucggccgucgugugguacggcgggcgccccgugaccgagauccccuccugggccggcaacauccugcggacgcaggagucggagugcgucugccacaaggggaucugucccguggugaugaccgacggcccggcgaacaaccgcgccgccaccaagaucaucuacuucaaggagggcaagauccagaagaucgaggagcucgaggggaacgcccagcacaucgaggagugcucgugcuacggcgccgcgggggucaucaagugcaucugccgggacaacuggaagggcgccaaccgccccgugaucaucaucgaccccgagaugaugacccacacguccaaguaccugugcucgcgggugcugaccgacaccucccgccccaacgacccgaucucggggaacugcgacgcccccaucaccggcggcucccccgaccccggggucaagggcuucgccuuccucgacggggagaauucguggcugggccggacgaucuccaaggacucgcgcuccggguacgagaugcugaaggugccgaacgccgagaccgacacccagucgggccccaccucccaccaggugaucgucaacaaccagaacuggucgggcuacuccggggcguucaucgacuacugggccaacaaggagugcuucaaccccugcuucuacguggagcucauccggggccgccccaaggagucguccgugcuguggacgucgaacuccaucgucgcccugugcgggucgaaggagcggcucggcuccuggucguggcacgacggggccgagaucaucuacuucaaguga

SEQ ID NO: 26028 - RNA, 1416 nt, Artificial Sequence
  derived and/or modified CDS sequence (AUadapt) from InfluenzaA__AGQ81864__NA
augaaucccaaccagaagcuguucgcccucucgggcguggccaucgcgcuguccguccugaaccuccugaucgggaucucgaacgugggccugaacgugucccuccaccugaaggagaaggggccgaagcaggaggagaacucgacgugcaccaccaucaaccagaacaacaccaccaucgucgagaacaccuacgugaacaacacgaccaucaucuccaaggagaccgagcugaagccgcccaauuaccuccugcugaacaagucgcucugcaacguggagggcugggucgugaucgccaaggacaacgccgugcgcuucggggaguccgagcagaucaucgucacccgggagcccuacgugucgugcgaccccacgggcugcaagauguacgcccugcaccagggcaccaccauccgcaacaagcacuccaacgggaccauccacgaucggacggccuuccgcggccugaucucgaccccgcucgggaccccgcccaccguguccaacucggacuucaucugcgucggcugguccucgacgaccugccacgacgggaucggccggaugaccaucugcauccagggcaacaacgacaacgcgaccgccacgguguacuacaaccgccggcugaccaccaccaucaagacgugggcccgcaauauccugcggacccaggaguccgagugcgugugccacaacgggaccugcgccgucgugaugaccgacggcucggcguccucgcaggccuacacgaaggugauguacuuccacaaggggcucgucaucaaggaggaggcccugaagggcuccgcccgccacaucgaggagugcucgugcuacggccacagucagaaggcgaccugcgugugccgggacaacuggcagggggccaaccgccccaucaucgagaucgacaugaacacccuggagcacaccucccgguacgugugcacgggcauccucaccgacaccucgcgccccggggacaaguccucgggcgacugcuccaaccccaucaccgggucgcccggcgcccccggcgucaagggguucggcuuucugaacggggacaacacguggcugggccggaccaucucccccaagucgcgcuccggguucgagaugcucaagauccccaacgccggcaccgaccccaacucgcggaucgccgagcgccaggagaucguggacaacaacaacugguccggcuacucgggguccuucaucgacuacugggacaaugacucggagugcuacaacccgugcuucuacguggagcugauccggggccgccccgaggaggccaaguacgucugguggaccuccaacucgcugaucgcgcucugcgggucccccuuccccgugggcucgggguccuucccggacggcgcccagauccaguacuucucguga

SEQ ID NO: 26029 - RNA, 1416 nt, Artificial Sequence
  derived and/or modified CDS sequence (AUadapt) from InfluenzaA__AGQ81865__NA
augaaucccaaccagaagcuguucgcccucucgggcguggccaucgcgcuguccguccugaaccuccugaucgggcugucgaacgugggccucaacgugucccugcaccugaaggagaccgggccgaagcaggagggcaaccugaccugcaugacgaucaaccagaacaacaccaccgucguggagaacaccuaugugaacaacacgaccaucaucaccaaggagaccgagucggagacgcccaacuaccuccugcucaacaagucccugugcaacgucgagggguggguggugaucgccaaggacaacgccguccgcuucggcgagucggagcagaucaucgugacccgggagcccuacguguccugcgaucccaacggcugcaagauguacgcccugcaccaggggaccaccauccgcaacaagcacucgaacggcacgauccacgaccggaccgccuuccgcgggcucaucuccaccccgcugggcaccccgcccacggucucgaacuccgacuuuaucugcgugggguggucguccacgaccugccacgacggcaucggccggaugaccaucugcauccaggggaacaacgacaacgcgaccgccaccguguacuacaaccgccggcugaccaccacgaucaagaccugggcccgcaacauccuccggacccaggagagugagugcgucugccacaacgggaccugcgccguggugaugacggacggcuccgcgucgucccaggcccacaccaaggucauguacuuccacaagggccugguggugaaggaggaggcccugaagggcucggcccgccacaucgaggagugcuccuguuacgggcacaaccagaaggugaccugcgucugccgggacaacuggcagggcgccaaccgccccaucaucgagaucgacaugaacacccucgagcacacgucgcgguacgugugcaccgggauccugaccgauaccucgcgccccggcgacaagcccacgggggacugcuccaaccccaucaccggcucgcccggcgcgccgggggucaagggcuucggguuccugaacggcgggaacaccuggcucggccggaccaucucgccccgcucccgguccggcuucgagaugcugaagauccccaacgccgggaccgaccccaauucgcgcaucgccgagcggcaggagaucguggacaacuccaacuggucgggcuacuccgggucguucaucgacuacuggaacgacaacuccgagugcuauaacccgugcuucuacgucgagcugauccgcggccggcccgaggaggccaaguacgugugguggacgucgaacucccucaucgcccugugcgggucgcccuuccccgugggcuccggcucguucccggacggggcgcagauccaguacuucuccuga

SEQ ID NO: 26030 - RNA, 1416 nt, Artificial Sequence
  derived and/or modified CDS sequence (AUadapt) from InfluenzaA__AGQ81868__NA
augaaucccaaccagaagcuguucgcccucucgggcguggccaucgcgcuguccguccugaaccuccugaucgggaucucgaacgugggccugaacgugucccuccaccugaaggagaaggggccgaagcaggaggagaacucgacgugcaccaccaucaaccagaacaacaccaccgucguggagaacaccuacgugaacaacacgaccaucaucaccaaggagaccgagcugaagacgcccuccuaccuccugcugaacaagucgcucugcaacgucgagggcuggguggugaucgccaaggacaacgccguccgcuucggggaguccgagcagaucaucgugacccgggagcccuacgugucgugcgaccccaccggcugcaagauguacgcccugcaccagggcaccacgauccgcaauaagcacuccaacgggaccauccacgaccggaccgccuuccgcggccugaucucgaccucccucgggacgccgcccaccaucucgaacuccgacuucaugugcgucggcuggucguccacgaccugccacgacgggaucggccggaugaccaucugcauccagggcaacaacgacaacgcgaccgccaccguguacuacaaccgccggcugaccacgaccaucaagaccugggcccgcaacauccugcggacccaggagucggagugcgugugccacaacgggaucugcgccgucgugaugacggacggcuccgcgucgucccaggccuacaccaaggugauguacuuucacaaggggcucgucgugaaggaggaggcccugaagggcucggcccgccacaucgaggagugcucgugcuacggccacucccagaaggugaccugcgucugccgggacaacuggcagggggccaaccgccccaucaucgagaucgacaugaacacccuggagcacacgucgcgguacgugugcaccggcauccucaccgacaccucccgccccggggacaagucguccggcgacugcucgaacccgaucgcggggucccccggcgcccccggcgugaagggguucggcuuccugaacggggacaacacguggcugggccggaccaucucgccccgcucccggucgggguuugagaugcucaagaucccgaacgccggcaccgaccccaacucccgcaucgccggccggcaggagaucgucgacaacaacaacuggucgggguacuccggcucguucaucgacuacuggaacgacaacuccgagugcuacaaccccugcuucuacguggagcugauccgcgggcggcccgaggaggccaaguacgucugguggaccucgaacucccugaucgcgcucugcggcucgccguuccccgugggguccggcucguuccccgacggcgcccagauccaguacuucucguga

SEQ ID NO: 26031 - RNA, 1416 nt, Artificial Sequence
  derived and/or modified CDS sequence (AUadapt) from InfluenzaA__AGQ81869__NA
augaaucccaaccagaagcuguucgcccucucgggcguggccaucgcgcuguccguccugaaccuccugaucgggaucucgaacgugggccugaacgugucccuccaccugaaggagaaggggccgaagcaggaggagaacucgacgugcaccaccaucaaccagaacaacaccaccaucgucgagaacaccuacgugaacaacacgaccaucaucuccaaggagaccgagcugaagacccccucguaccuccugcugaacaagucccucugcaauguggagggcugggucgugaucgccaaggacaacgccgugcgcuucggggagucggagcagaucaucgucacgcgggagcccuacguguccugcgaccccaccggcugcaagauguacgcccugcaccagggcaccaccauccgcaacaagcacucgaacgggacgauccacgaccggaccgccuuccgcggccugaucuccaccccgcucgggaccccgcccacggugucgaacuccgacuucaucugcgucggcuggaguuccacgaccugccacgacgggaucggccggaugaccaucugcauccagggcaacaacgacaacgcgaccgccaccguguacuacaaccgccggcugaccaccacgauccgcaccugggcccggaacauccugcgcacccaggagucggagugcgugugccacaacgggaccugcgccgucgugaugacggacggcuccgcgucgucccaggccuacaccaaggugauguacuuucacaaggggcucgucaucaaggaggaggcccugaagggcucggcccggcacaucgaggagugcucgugcuacggccacucccagaaggcgaccugcgugugccgcgacaacuggcagggggccaaccggcccaucaucgagaucgacaugaacacccuggagcacacgucgcgcuacgugugcaccggcauccucaccgacaccucccggcccggggacaagucguccggcgauugcucgaaccccaucacggggucccccggcgcccccggcgucaagggguucggcuuccugaacggggacaacaccuggcugggccgcaccaucucgccgcggucccgcucgggguucgagaugcucaagauccccaacgccggcaccgaccccaacucccggaucgccgagcgccaggagaucguggacaacaacaacuggucgggcuacuccgggucguucaucgauuacuggaacaacgacuccgagugcuacaaccccugcuucuacguggagcugauccggggccgcccggaggaggccaaguacgucugguggaccucgaacucccugaucgcgcucugcgggucgcccuuccccgugggcuccgggucguuccccgacggcgcccagauccaguacuucucguga

SEQ ID NO: 26032 - RNA, 1416 nt, Artificial Sequence
  derived and/or modified CDS sequence (AUadapt) from InfluenzaA__AGQ81870__NA
augaaucccaaccagaagcuguucgcccucucgggcguggccaucgcgcuguccguccugaaccuccugaucgggaucucgaacgugggccugaacgugucccuccaccugaaggagaaggggccgaagcaggaggagaacucgacgugcaccaccaucaaccagaacaacaccaccaucgucgagaacaccuacgugaacaacacgaccaucaucuccaaggagaccgagcugaagccgcccucguaccuccugcugaacaagucccucugcaauguggagggcugggucgugaucgccaaggacaacgccgugcgcuucggggagucggagcagaucaucgucacccgggagcccuacguguccugcgaccccacgggcugcaagauguacgcccugcaccagggcaccaccauccgcaacaagcacucgaacgggaccauccacgaccggacggccuuccgcggccugaucuccaccccgcucgggaccccgcccaccgugucgaacuccgacuucaucugcgucggcuggaguuccacgaccugccacgacgggaucggccggaugaccaucugcauccagggcaacaacgacaacgcgaccgccacgguguacuacaaccgccggcugaccaccaccauccgcacgugggcccggaacauccugcgcacccaggagucggagugcgugugccacaacgggaccugcgccgucgugaugaccgacggcuccgcgucgucccaggccuacacgaaggugauguacuuucacaaggggcucgucaucaaggaggaggcccugaagggcucggcccggcacaucgaggagugcucgugcuacggccacucccagaaggcgaccugcgugugccgcgacaacuggcagggggccaaccggcccaucaucgagaucgacaugaacacccuggagcacaccucgcgcuacgugugcacgggcauccucaccgacaccucccggcccggggacaagucguccggcgauugcucgaaccccaucaccgggucccccggcgcccccggcgucaagggguucggcuuccugaacggggacaacacguggcugggccgcaccaucucgccccggucccgcucgggguucgagaugcucaagauccccaacgccggcaccgaccccaacucccggaucgccgagcgccaggagaucguggacaacaacaacuggucgggcuacuccgggucguucaucgauuacuggaacaacgacuccgagugcuacaacccgugcuucuacguggagcugauccggggccgccccgaggaggccaaguacgucugguggaccucgaacucccugaucgcgcucugcgggucgcccuuccccgugggcuccgggucguucccggacggcgcccagauccaguacuucucguga

SEQ ID NO: 26033 - RNA, 1416 nt, Artificial Sequence
  derived and/or modified CDS sequence (AUadapt) from InfluenzaA__AGQ81871__NA
augaaucccaaccagaagcuguucgcccucucgggcguggccaucgcgcuguccguccugaaccuccugaucgggaucucgaacgugggccugaacgugucccuccaccugaaggagaaggggccgaagcaggaggagaacucgacgugcaccaccaucaaccagaacaacaccaccaucgucgagaacaccuacgugaacaacacgaccaucaucuccaaggagaccgagcugaagacccccucguaccuccugcugaacaagucccucugcaauguggagggcugggucgugaucgccaaggacaacgccgugcgcuucggggagucggagcagaucaucgucacgcgggagcccuacguguccugcgaccccaccggcugcaagauguacgcccugcaccagggcaccaccauccgcaacaagcacucgaacgggacgauccacgaccggaccgccuuccgcggccugaucuccaccccgcucgggaccccgcccacggugucgaacuccgacuucaucugcaucggcuggaguuccacgaccugccacgacgggaucggccggaugaccaucugcauccagggcaacaacgacaacgcgaccgccaccgucuacuacaaccgccggcugaccaccacgauccgcaccugggcccggaacauccugcgcacccaggagucggagugcgugugccacaacgggaccugcgccguggucaugacggacggcuccgcgucgucccaggccuacaccaaggugauguacuuucacaaggggcucgugaucaaggaggaggcccugaagggcucggcccggcacaucgaggagugcucgugcuacggccacucccagaaggcgaccugcgucugccgcgacaacuggcagggggccaaccggcccaucaucgagaucgacaugaacacccuggagcacacgucgcgcuacgugugcaccggcauccucaccgacaccucccggcccggggacaagucguccggcgauugcucgaaccccaucacggggucccccggcgcccccggcgugaagggguucggcuuccugaacggggacaacaccuggcugggccgcaccaucucgccgcggucccgcucgggguucgagaugcucaagauccccaacgccggcaccgaccccaacucccggaucgccgagcgccaggagaucgucgacaacaacaacuggucgggcuacuccgggucguucaucgauuacuggaacaacgacuccgagugcuacaaccccugcuucuacguggagcugauccggggccgcccggaggaggccaaguacgugugguggaccucgaacucccugaucgcgcucugcgggucgcccuuccccgucggcuccgggucguuccccgacggcgcccagauccaguacuucucguga

SEQ ID NO: 26034 - RNA, 1416 nt, Artificial Sequence
  derived and/or modified CDS sequence (AUadapt) from InfluenzaA__AGQ81872__NA
augaaucccaaccagaagcuguucgcccucucgggcguggccaucgcgcuguccguccugaaccuccugaucgggaucucgaacgugggccugaacgugucccuccaccugaaggagaaggggccgaagcaggaggagaacucgacgugcaccaccaucaaccagaacaacaccaccaucgucgagaacaccuacgugaacaacacgaccaucaucuccaaggagaccgagcugaagacccccucguaccuccugcugaacaagucccucugcaacguggagggcugggucgugaucgccaaggacaacgccgugcgcuucggggagagugagcagaucaucgucacgcgggagcccuacguguccugcgaccccaccggcugcaagauguacgcccugcaccagggcaccaccauccgcaacaagcacucgaacgggacgauccacgaccggaccgccuuccgcggccugaucuccaccccgcucgggaccccgcccucgguguccaacucggacuucaucugcgucggcugguccucgacgaccugccacgacgggaucggccggaugaccaucugcauccagggcaacaacgacaaugcgaccgccacgguguacuacaaccgccggcugaccaccaccauccgcacgugggcccggaacauccugcgcacccaggaguccgagugcgugugccacaacgggaccugcgccgucgugaugaccgacggcucggcguccucgcaggccuacacgaaggugauguacuuccacaaggggcucgucaucaaggaggaggcccugaagggcucggcccggcacaucgaggagugcuccugcuacggccacucgcagaaggcgaccugcgugugccgcgacaauuggcagggggccaaccggcccaucaucgagaucgacaugaacacccuggagcacaccucccgcuacgugugcacgggcauccucaccgacaccucgcggcccggggacaaguccucgggcgacugcuccaaccccaucaccgggucgcccggcgcccccggcgucaagggguucggcuuccugaacggggacaacacguggcugggccgcaccaucuccccgcggucgcgcuccggguucgagaugcucaagauccccaacgccggcaccgaccccaacucgcggaucgccgagcgccaggagaucguggacaacaauaacugguccggcuacucgggguccuucaucgacuacuggaacaacgacucggagugcuacaaccccugcuucuacguggagcugauccggggccgcccggaggaggccaaguacgucugguggaccuccaacucgcugaucgcgcucugcgggucccccuuccccgugggcucggggucguuccccgacggcgcccagauccaguacuucuccuga

SEQ ID NO: 26035 - RNA, 1416 nt, Artificial Sequence
  derived and/or modified CDS sequence (AUadapt) from InfluenzaA__AGQ81875__NA
augaaucccaaccagaagcuguucgcccucucgggcguggccaucgcgcuguccguccugaaccuccugaucgggaucucgaacgugggccugaacgugucccuccaccugaaggagaaggggccgaagcaggaggagaacucgacgugcaugaccaucaaccagaauaacaccaccgucguggagaacaccuacgugaacaacaccacgaucaucaccaaggagaccgagcuggagacccccuccuaccuccugcugaacaagggccucugcaacgucgagggguggguggugaucgccaaggacaacgccguccgcuucggcgagacggagcagaucaucgugacccgggagcccuacgugaguugcgaccccaacggcugcaagauguacgcccugcaccaggggaccaccauccgcaacaagcacuccaacggcacgauccacgaccggaccgccuuccgcgggcugaucaguaccccgcucggcaccccgcccacggucuccaacucggacuucaucugcguggggugguccucgacgaccugccacgacggcaucggccggaugaccaucugcauccaggggaacaacgacaaugcgaccgccaccguguacuacaaccgccggcugaccaccacgaucaagaccugggcccgcaacauccugcggacccaggaguccgagugcgucugccacaacgggaccugcgccguggugaugacggacggcucggcguccucgcaggcccacaccaaggucaucuauuuccacaagggccucaucgugaaggaggaggcccugaagggcuccgcccgccacaucgaggagugcucgugcuacgggcacucccagaaggugaccugcgucugccgggacaacuggcagggcgccaaucgccccaucaucgagaucgacaugaacacccuggagcacacgucgcgguacgugugcaccgggauccucaccgacaccucgcgccccggcgacaaguccacgggggacugcucgaaccccaucaccggcucccccggcgcgcccggggugaagggcuuuggguaccugaacggcgacaacaccuggcuggggcggaccaucucgccgcgcucccggucgggcuucgagaugcucaagauccccaacgccggcaccgaccccaacucccgcaucacggagcggcaggagaucgucgacaacaauaacuggucgggguacuccggcucguucguggacuacuggaacgacaacuccgagugcuacaaccccuguuucuacgucgagcugauccgcgggcggccggaggaggccaaguacgugugguggaccucgaacuccaucaucgcccugugcggcucgcccuuccccgugggguccggcucguuccccgacggcgcccagauccaguacuucuccuga

SEQ ID NO: 26036 - RNA, 1416 nt, Artificial Sequence
  derived and/or modified CDS sequence (AUadapt) from InfluenzaA__AGQ81876__NA
augaaucccaaccagaagcuguucgcccucucgggcguggccaucgcgcuguccguccugaaccuccugaucgggaucucgaacgugggccugaacgugucccuccaccugaaggagaaggggccgaagcaggaggagaacucgacgugcaugaccaucaaccagaauaacaccaccgucguggagaacaccuacgugaacaacaccacgaucaucaccaaggagaccgagcuggagacccccuccuaccuccugcugaacaagggccucugcaacgucgagggguggguggugaucgccaaggacaacgccguccgcuucggcgagacggagcagaucaucgugacccgggagcccuacgugaguugcgaccccaacggcugcaagauguacgcccugcaccaggggaccaccauccgcaacaagcacuccaacggcacgauccacgaccggaccgccuuccgcgggcugaucaguaccccgcucggcaccccgcccacggucuccaacucggacuucaucugcguggggugguccucgacgaccugccacgacggcaucggccggaugaccaucugcauccagggggacaacgacaaugcgaccgccaccguguacuacaaccgccggcugaccaccacgaucaagaccugggcccgcaacauccugcggacccaggaguccgagugcgucugccacaacgggaccugcgccguggugaugacggacggcucggcguccucgcaggcccacaccaaggucaucuauuuccacaagggccucaucgugaaggaggaggcccugaagggcuccgcccgccacaucgaggagugcucgugcuacgggcacucccagaaggugaccugcgucugccgggacaacuggcagggcgccaaucgccccaucaucgagaucgacaugaacacccuggagcacacgucgcgguacgugugcaccgggauccucaccgacaccucgcgccccggcgacaaguccacgggggacugcucgaaccccaucaccggcucccccggcgcgcccggggugaagggcuuuggguaccugaacggcgacaacaccuggcuggggcggaccaucucgccgcgcucccggucgggcuucgagaugcucaagauccccaacgccggcaccgaccccaacucccgcaucacggagcggcaggagaucgucgacaacaauaacuggucgggguacuccggcucguucguggacuacuggaacgacaacuccgagugcuacaaccccuguuucuacgucgagcugauccgcgggcggccggaggaggccaaguacgugugguggaccucgaacuccaucaucgcccugugcggcucgcccuuccccgugggguccggcucguuccccgacggcgcccagauccaguacuucuccuga

SEQ ID NO: 26037 - RNA, 1416 nt, Artificial Sequence
  derived and/or modified CDS sequence (AUadapt) from InfluenzaA__AGQ81877__NA
augaaucccaaccagaagcuguucgcccucucgggcguggccaucgcgcuguccguccugaaccuccugaucgggaucucgaacgugggccugaacgugucccuccaccugaaggagaaggggccgaagcaggaggagaacucgacgugcaccaccaucaaccagaacaacaccaccgucguggagaacaccuacgugaacaacacgaccaucaucaccaaggagaccgagcugaagacgcccuccuaccuccugcugaacaagucgcucugcaacgucgagggcuggguggugaucgccaaggacaacgccguccgcuucggggaguccgagcagaucaucgugacccgggagcccuacgugucgugcgaccccaccggcugcaagauguacgcccugcaccagggcaccacgauccgcaauaagcacuccaacgggaccauccacgaccggaccgccuuccgcggccugaucucgaccucccucgggacgccgcccaccaucucgaacuccgacuucaugugcgucggcuggucguccacgaccugccacgacgggaucggccggaugaccaucugcauccagggcaacaacgacaacgcgaccgccaccguguacuacaaccgccggcugaccacgaccaucaagaccugggcccgcaacauccugcggacccaggagucggagugcgugugccacaacgggaucugcgccgucgugaugacggacggcuccgcgucgucccaggccuacaccaaggugauguacuuucacaaggggcucgucgugaaggaggaggcccugaagggcucggcccgccacaucgaggagugcucgugcuacggccacucccagaaggugaccugcgucugccgggacaacuggcagggggccaaccgccccaucaucgagaucgacaugaacacccuggagcacacgucgcgguacgugugcaccggcauccucaccgacaccucccgccccggggacaagucguccggcgacugcucgaacccgaucacggggucccccggcgcgcccggcgugaagggguucggcuuccugaacggggacaacaccuggcugggccggaccaucucgccccgcucccggucgggguuugagaugcucaagaucccgaacgccggcaccgaccccaacucccgcaucgccggccggcaggagaucgucgacaacaacaacuggucgggguacuccggcucguucaucgacuacuggaacgacaacuccgagugcuacaaccccugcuucuacguggagcugauccgcgggcggcccgaggaggccaaguacgucugguggaccucgaacucccugaucgcccucugcggcucgccguuccccgugggguccggcucguuccccgacggcgcgcagauccaguacuucucguga

SEQ ID NO: 26038 - RNA, 1416 nt, Artificial Sequence
  derived and/or modified CDS sequence (AUadapt) from InfluenzaA__AGQ81878__NA
augaaucccaaccagaagcuguucgcccucucgggcguggccaucgcgcuguccguccugaaccuccugaucgggaucucgaacgugggccugaacgugucccuccaccugaaggagaaggggccgaagcaggaggagaaccugaccugcaccacgaucaaccagaacaacaccaccgucguggagaacaccuacgugaacaacacgaccaucaucaccaaggagaccgaccucaaggcccccucguaccugcugcucaacaagucccuguguaacgucgagggcuggguggugaucgccaaggacaacgccguccgcuucggggagucggagcagaucaucgugacgcgggagcccuacguguccugcgaccccaccggcugcaagauguacgcccugcaccagggcaccaccauccgcaacaagcacucgaacgggacgauccacgaccggaccgcguuccgcggccucaucuccaccccgcuggggaccccgcccacggucucgaacuccgacuucaugugugugggcuggucguccacgaccugccacgacgggaucggccggaugaccaucugcauccagggcaacaacgacaacgccaccgccaccguguacuacaaccgccggcugaccaccacgaucaagaccugggcccgcaacauccuccggacccaggagucggagugcgucugccacaacgggaccugcgcgguggugaugacggacggcuccgccucgucccaggccuacaccaaggucauguauuuccacaaggggcugguggugaaggaggaggcccugaagggcucggcccgccacaucgaggagugcuccugcuacggccacucgcagaaggugaccugcgucugccgggacaacuggcagggggcgaaccgccccaucaucgagaucgacaugaacacccucgagcacacgucgcgguacgugugcaccggcauccugaccgacaccucccgccccggggacaagaguuccggcgacugcucgaaccccaucacggggucccccggcgcccccggcgucaagggguucggcuuccugaacggggacaacaccuggcucggccggaccaucucgccgcgcucccggucgggguucgagaugcugaagauccccaacgccggcaccgaccccaacucccgcaucgccgagcggcaggagaucguggacaacaacaacuggucgggcuacuccgggucguuuaucgacuacuggaacgacaacuccgagugcuacaaccccugcuucuacgucgagcugauccgcggccggccggaggaggccaaguacgugugguggaccucgaacucccucaucgcgcugugcgggucgcccuuccccaucggcuccgggucguuccccgacggcgcccagauccaguacuucuccuga

SEQ ID NO: 26039 - RNA, 1416 nt, Artificial Sequence
  derived and/or modified CDS sequence (AUadapt) from InfluenzaA__AGQ81882__NA
augaaucccaaccagaagcuguucgcccucucgggcguggccaucgcgcuguccguccugaaccuccugaucgggaucucgaacgugggccugaacgugucccuccaccugaaggagaagggggccaagcaggaggagaaccugaccugcaccacgaucaaccagaacaacaccaccgucguggagaacaccuacgugaacaacacgaccgucaucaccaaggaggccgacuggaagaccccgucguaccuccugcugaacaagucccucugcaacguggagggcuggguggucaucgccaaggacaacgccauccgcuucggggagagugagcagaucaucgugacgcgggagcccuacguguccugcgaccccaccggcugcaagauguacgcgcugcaccagggcaccaccauccgcaacaagcacucgaacgggacgauccacgaccggaccgccuuccgcggccugaucuccacgccccucgggaccccgcccaccgucucgaacuccgacuucaugugcgugggcuggucguccacgaccugccacgacgggaucggccggaugaccaucugcauccagggcaacaacgacaaugccaccgccaccguguacuacaacgggcgccugaccaccacgaucaagaccugggcgcggaacauccugcgcacccaggagucggagugcgucugccacaacgggaccugcgccguggugaugacggacggcuccgccucgucccaggccuacaccaaggucauguacuuccacaagggccucgugaucaaggaggaggcccugaagggcucggcgcggcacaucgaggagugcuccugcuacgggcacucgcagaaggugaccugcgucugccgcgacaacuggcagggcgccaaucggcccaucaucgagaucgacaugaacacccuggagcacacgucgcgcuacgugugcaccgggauccucaccgacaccucccggcccggcgacaagucguccggggacugcucgaacccgaucacgggcucccccggcgcccccggggugaagggcuucggguuccugaacggcgacaacaccuggcuggggcgcaccaucucgccccggucccgcucgggcuucgagaugcucaagaucccgaacgccggcaucgaccccaacucccggaucgccgagcgccaggagaucgucgacaacaauaacuggucgggguacuccggcucguucaucgacuacuggaacgacaacuccgagugcuacaaccccugcuucuacguggagcugauccgggggcgccccgaggaggcgaaguacgucugguggaccucgaacucccugaucgcccucugcggcucgccguuccccgugggguccggcucguuccccgacggcgcccagauccaguacuucuccuga

SEQ ID NO: 26040 - RNA, 1416 nt, Artificial Sequence
  derived and/or modified CDS sequence (AUadapt) from InfluenzaA__AGQ81883__NA
augaaucccaaccagaagcuguucgcccucucgggcguggccaucgcgcuguccguccugaaccuccugaucgggaucucgaacgugggccugaacgugucccuccaccugaaggagaaggggccgaagcaggaggagaaccugaccugcaccacgaucaaccagaacaacaccaccgucguggagaacaccuacgugaacaacacgaccgucaucaccaaggaggccgacuggaagacccccucguaccuccugcugaacaagucccucugcaacguggagggcuggguggucaucgccaaggacaacgccauccgcuucggggagagugagcagaucaucgugacgcgggagcccuacguguccugcgaccccaccggcugcaagauguacgcccugcaccagggcaccaccauccgcaacaagcacucgaacgggacgauccacgaccggaccgcguuccgcggccugaucuccaccccgcucgggaccccgcccacggucucgaacuccgacuucaugugcgugggcuggucguccacgaccugccacgacgggaucggccggaugaccaucugcauccagggcaacaacgacaaugccaccgccaccguguacuacaacgggcgccugaccaccacgaucaagaccugggcccggaacauccugcgcacccaggagucggagugcgucugccacaacgggaccugcgcgguggugaugacggacggcuccgccucgucccaggccuacaccaaggucauguacuuccacaagggccucgugaucaaggaggaggcccugaagggcucggcccggcacaucgaggagugcuccugcuacgggcacucgcagaaggugaccugcgucugccgcgacaacuggcagggcgcgaaucggcccaucaucgagaucgacaugaacacccuggagcacacgucgcgcuacgugugcaccgggauccucaccgacaccucccggcccggcgacaagucguccggggacugcucgaaccccaucacgggcucccccggcgcccccggggugaagggcuucggguuccugaacggcgacaacaccuggcuggggcgcaccaucucgccgcggucccgcucgggcuucgagaugcucaagauccccaacgccggcaucgaccccaacucccggaucgccgagcgccaggagaucgucgacaacaauaacuggucgggguacuccggcucguucaucgacuacuggaacgacaacuccgagugcuacaaccccugcuucuacguggagcugauccgggggcgcccggaggaggccaaguacgucugguggaccucgaacucccugaucgcgcucugcggcucgcccuuccccgugggguccggcucguuccccgacggcgcccagauccaguacuucuccuga

SEQ ID NO: 26041 - RNA, 1416 nt, Artificial Sequence; identical to SEQ ID NO: 26040
  derived and/or modified CDS sequence (AUadapt) from InfluenzaA__AGQ81884__NA

SEQ ID NO: 26042 - RNA, 1416 nt, Artificial Sequence; identical to SEQ ID NO: 26040
  derived and/or modified CDS sequence (AUadapt) from InfluenzaA__AGQ81885__NA

SEQ ID NO: 26043 - RNA, 1416 nt, Artificial Sequence; identical to SEQ ID NO: 26040
  derived and/or modified CDS sequence (AUadapt) from InfluenzaA__AGQ81886__NA

SEQ ID NO: 26044 - RNA, 1356 nt, Artificial Sequence
  derived and/or modified CDS sequence (AUadapt) from InfluenzaA__AGQ81888__NA
augaaucccaaccagaagcuguucgcccucucgggcguggccaucgcgcuguccguccugaaccuccugaucgggcugaguaacgugggccucaacgugucccugcaccugaaggaggccgggccgaagcaggaggagaaccugaccuguaugaccacgaaggagaccgagcucggcacccccucguaccugcuccugaacaagucccugugcaacgucgagggguggguggugaucgccaaggauaacgccguccgcuucggcgagagcgagcagaucaucaucacccgggagcccuacguguccugugaccccaacggcugcaagauguacgcccuccaucaggggacgaccauccgcaacaagcacucgaacggcaccauccacgaucggaccgcguuccgcgggcugaucuccacgccgcugggcaccccgcccaccgugagcaacuccgacuuuaucugcgucggguggucguccaccacgugccacgacggcaucggccggaugaccaucuguauccaggggaacaacgacaacgccaccgccaccguguauuacaaccgccggcucacgaccaccaucaagaccugggcccgcaacauccugcggacgcaggagagcgagugugugugccacaacgggaccugcgcggucgugaugaccgacggcuccgccaguucccaggcccacaccaaggugauguacuuccacaagggccuggucgugaaggaggaggcccucaagggcagugccaagcacaucgaggagugcuccugcuacgggcauaaccagaaggugacgugcgucugccgcgacaacuggcagggcgcgaaucggcccaucaucgagaucgacaugaacacccuggagcacaccucgcgcuaugugugcaccgggauccugacggacaccagccggcccggcgacaagcccaccggggacuguuccaaccccaucaccggcucgcccggcgccccgggggugaagggcuucggguuccucaauggcgacaacacguggcuggggcgcaccaucagcccccggucccgcuccggcuucgagaugcugaagauccccaaugccggcaucgaccccaacucgcggaucgccgagcgccaggagaucgucgacaacuccaauuggagcggguacuccggcucguucaucgauuacuggaacgacaacuccgaguguuacaacccgugcuucuacguggagcucauccgggggcgccccgaggaggccaaguaugugugguggaccagcaacucccugaucgcgcugugcggcucgcccuuucccgucggguccggcagcuucccggacggcgcccagauccaguacuucuccuga

SEQ ID NO: 26045 - RNA, 1356 nt, Artificial Sequence
  derived and/or modified CDS sequence (AUadapt) from InfluenzaA__AGQ81889__NA
augaaucccaaccagaagcuguucgcccucucgggcguggccaucgcgcuguccguccugaaccuccugaucgggcugaguaacgugggccucaacgugucccugcaccugaaggagaccgggccgaagcaggaggagaaccugaccugcaugacgaccaaggagaccgagcucggcacccccaguuaccugcuccugaacaagucccugugcaacgucgagggguggguggugaucgccaaggauaacgccguccgcuucggcgagucggagcagaucaucaucacgcgggagcccuacguguccugcgaucccaacggcugcaagauguacgcccuccaccaggggaccaccauccgcaacaagcauagcaacggcaccauccacgaccggacggccuuucgcgggcugaucuccaccccgcugggcaccccgcccaccgugucgaacuccgacuucaucugcgucggguggaguuccacgaccugccacgacggcaucggccggaugaccaucugcauccaggggaauaacgacaacgcgaccgccacgguguacuacaaucgccggcucaccaccaccaucaagacgugggcccgcaacauccugcggacccaggagucggagugcgugugccacaaugggaccugcgccgucgugaugaccgacggcuccgcgagcucccaggcccacacgaaggugauguauuuccacaagggccuggucgugaaggaggaggcccucaagggcucggccaagcacaucgaggagugcuccuguuacgggcacaaccagaaggugaccugcgucugucgcgacaacuggcagggcgccaaccggcccaucaucgagaucgacaugaacacccuggagcauaccucgcgcuacgugugcacggggauccugaccgacaccagccggcccggcgauaagcccaccggggacugcuccaaccccaucacgggcucgcccggcgcgccgggggugaagggcuuuggguuccucaacggcgacaacaccuggcuggggcgcaccaucagcccccggucccgcuccggcuuugagaugcugaagauccccaacgccggcaucgaccccaacucgcggaucgccgagcgccaggagaucgucgauaacuccaacuggagcggguacuccggcucguuuaucgacuacuggaacgacaacuccgaguguuacaacccgugcuucuauguggagcucauccgggggcgccccgaggaggccaaguacgugugguggaccagcaacucccugaucgcccugugcggcucgcccuuucccgucggguccggcagcuucccggacggcgcgcagauccaguacuucuccuga

SEQ ID NO: 26046 - RNA, 1356 nt, Artificial Sequence; identical to SEQ ID NO: 26045
  derived and/or modified CDS sequence (AUadapt) from InfluenzaA__AGQ81890__NA

SEQ ID NO: 26047 - RNA, 1356 nt, Artificial Sequence; identical to SEQ ID NO: 26045
  derived and/or modified CDS sequence (AUadapt) from InfluenzaA__AGQ81891__NA

SEQ ID NO: 26048 - RNA, 1356 nt, Artificial Sequence
  derived and/or modified CDS sequence (AUadapt) from InfluenzaA__AGQ81893__NA
augaaucccaaccagaagcuguucgcccucucgggcguggccaucgcgcuguccguccugaaccuccugaucgggcugaguaacgugggccucaacgugucccugcaccugaaggagaccgggccgaagcaggaggagaaccugaccuguaugacgaccaaggagaccgagcucggcacccccucguaccugcuccugaacaagucccugugcaacgucgagggguggguggugaucgccaaggauaacgccguccgcuucggcgagagcgagcagaucaucaucacgcgggagcccuacguguccugugaccccaacggcugcaagauguacgcccuccaucaggggaccaccauccgcaacaagcacucgaacggcaccauccacgaucggacggccuuccgcgggcugaucuccaccccgcugggcaccccgcccaccgugagcaacuccgacuuuaucugcgucggguggucguccacgaccugccacgacggcaucggccggaugaccaucuguauccaggggaacaacgacaacgcgaccgccacgguguauuacaaccgccggcucaccaccaccaucaagacgugggcccgcaacauccugcggacccaggagagcgagugugugugccacaacgggaccugcgccgucgugaugaccgacggcuccgcgaguucccaggcccacacgaaggugauguacuuccacaagggccuggucgugaaggaggaggcccucaagggcagugccaagcacaucgaggagugcuccugcuacgggcauaaccagaaggugaccugcgucugccgcgacaacuggcagggcgccaaucggcccaucaucgagaucgacaugaacacccuggagcacaccucgcgcuaugugugcacggggauccugaccgacaccagccggcccggcgacaagcccaccggggacuguuccaaccccaucacgggcucgcccggcgcgccgggggugaagggcuucggguuccucaauggcgacaacaccuggcuggggcgcaccaucagcccccggucccgcuccggcuucgagaugcugaagauccccaaugccggcaucgaccccaacucgcggaucgccgagcgccaggagaucgucgacaacuccaauuggagcggguacuccggcucguucaucgauuacuggaacgacaacuccgaguguuacaacccgugcuucuacguggagcucauccgggggcgccccgaggaggccgaguaugugugguggaccagcaacucccugaucgcccugugcggcucgcccuuucccgucggguccggcagcuucccggacggcgcgcagauccaguacuucuccuga

SEQ ID NO: 26049 - RNA, 1356 nt, Artificial Sequence; identical to SEQ ID NO: 26045
  derived and/or modified CDS sequence (AUadapt) from InfluenzaA__AGQ81894__NA

SEQ ID NO: 26050 - RNA, 1356 nt, Artificial Sequence; identical to SEQ ID NO: 26045
  derived and/or modified CDS sequence (AUadapt) from InfluenzaA__AGQ81895__NA

SEQ ID NO: 26051 - RNA, 1356 nt, Artificial Sequence; identical to SEQ ID NO: 26045
  derived and/or modified CDS sequence (AUadapt) from InfluenzaA__AGQ81896__NA

SEQ ID NO: 26052 - RNA, 1356 nt, Artificial Sequence; identical to SEQ ID NO: 26045
  derived and/or modified CDS sequence (AUadapt) from InfluenzaA__AGQ81897__NA

SEQ ID NO: 26053 - RNA, 1356 nt, Artificial Sequence; identical to SEQ ID NO: 26045
  derived and/or modified CDS sequence (AUadapt) from InfluenzaA__AGQ81898__NA

SEQ ID NO: 26054 - RNA, 1356 nt, Artificial Sequence; identical to SEQ ID NO: 26045
  derived and/or modified CDS sequence (AUadapt) from InfluenzaA__AGQ81899__NA

SEQ ID NO: 26055 - RNA, 1356 nt, Artificial Sequence; identical to SEQ ID NO: 26045
  derived and/or modified CDS sequence (AUadapt) from InfluenzaA__AGQ81900__NA

SEQ ID NO: 26056 - RNA, 1356 nt, Artificial Sequence; identical to SEQ ID NO: 26045
  derived and/or modified CDS sequence (AUadapt) from InfluenzaA__AGQ81901__NA

SEQ ID NO: 26057 - RNA, 1356 nt, Artificial Sequence; identical to SEQ ID NO: 26045
  derived and/or modified CDS sequence (AUadapt) from InfluenzaA__AGQ81902__NA

SEQ ID NO: 26058 - RNA, 1356 nt, Artificial Sequence; identical to SEQ ID NO: 26045
  derived and/or modified CDS sequence (AUadapt) from InfluenzaA__AGQ81903__NA

SEQ ID NO: 26059 - RNA, 1356 nt, Artificial Sequence
  derived and/or modified CDS sequence (AUadapt) from InfluenzaA__AGQ81904__NA
augaaucccaaccagaagcuguucgcccucucgggcguggccaucgcgcuguccguccugaaccuccugaucgggcugaguaacgugggccucaacgugucccugcaccugaaggagaccgggccgaagcaggaggagaaccugaccugcaugacgaccaaggagaccgagcucggcacccccaguuaccugcuccugaacaagucccugugcaacgucgagggguggguggugaucgccaaggacaaugccguccgcuucggcgagucggagcagaucaucaucacgcgggagcccuacguguccugcgaccccaauggcugcaagauguacgcccuccaccaggggaccaccauccgcaacaagcacaguaacggcaccauccacgaccggacggccuuccgcgggcugaucuccaccccgcugggcaccccgcccaccgugucgaauuccgacuucaucugcgucggguggucguccacgaccugccaugacggcaucggccggaugaccaucugcauccaggggaacaacgauaacgcgaccgccacgguguacuacaaccgccggcucaccaccaccaucaagacgugggcccgcaacauccugcggacccaggagagugagugcgugugccacaacgggaccugcgccgucgugaugaccgauggcuccgcgucgucccaggcccacacgaaggugauguacuuccacaagggccuggucgugaaggaggaggcccucaagggcagugccaagcacaucgaggagugcuccugcuacgggcacaaucagaaggugaccugcgucugccgcgacaacuggcagggcgccaaccggcccaucaucgagaucgauaugaacacccuggagcacaccucgcgcuacgugugcacggggauccugaccgauaccucgcggcccggcgacaagcccaccggggacugcuccaaucccaucacgggcagccccggcgcgccgggggugaagggcuucggguuccucaacggcgacaauaccuggcuggggcgcaccaucucgccccggucccgcuccggcuucgagaugcugaagauccccaacgccggcaucgaccccaacagucggaucaccgagcgccaggagaucgucgacaacuccaacuggucgggguacuccggcaguuucaucgacuacuggaacgacaauuccgagugcuacaacccgugcuucuauguggagcucauccgggggcgccccgaggaggccaaguacgugugguggacgagcaacucccugaucgcccugugcggcucgcccuuucccgucggguccggcagcuucccggacggcgcccagauccaguacuucuccuga

SEQ ID NO: 26060 - RNA, 1356 nt, Artificial Sequence; identical to SEQ ID NO: 26045
  derived and/or modified CDS sequence (AUadapt) from InfluenzaA__AGQ81905__NA

SEQ ID NO: 26061 - RNA, 1356 nt, Artificial Sequence
  derived and/or modified CDS sequence (AUadapt) from InfluenzaA__AGQ81906__NA
augaaucccaaccagaagcuguucgcccucucgggcguggccaucgcgcuguccguccugaaccuccugaucgggcugaguaacgugggccucaacgugucccugcaccugaaggagaccgggccgaagcaggaggagaaccugaccuguaugacgaccaaggagaccgagcucggcacccccucguaccugcuccugaacaagucccugugcaaugucgagggguggguggugaucgccaaggacaacgccguccgcuucggcgagagcgagcagaucaucaucacgcgggagcccuauguguccugcgaccccaacggcugcaagauguaugcccuccaccaggggaccaccauccgcaacaagcacucgaauggcaccauccacgaccggacggccuuccgcgggcugaucuccaccccgcugggcaccccgcccaccgugagcaacuccgauuucaucugcgucggguggucguccacgaccugccaugacggcaucggccggaugaccaucugcauccaggggaacaacgauaacgcgaccgccacgguguacuacaaccgccggcucaccaccaccaucaagacgugggcccgcaauauccugcggacccaggagagcgagugcgugugccacaaugggaccugcgccgucgugaugaccgacggcuccgcgucgucccaggcccacacgaaggugauguauuuccacaagggccuggucgugaaggaggaggcccucaagggcagcgcccgccacaucgaggagugcuccuguuacgggcacaaccagaaggugaccugcgucugucgggacaacuggcagggcgccaaccgccccaucaucgagaucgacaugaauacccuggagcacaccagccgguacgugugcacggggauccugaccgauaccucgcgccccggcgacaagcccaccggggacugcuccaaucccaucacgggcagccccggcgcgccgggggugaagggcuucggguuccucaacggcgauaacaccuggcuggggcggaccaucucgccccgcucccgguccggcuucgagaugcugaagauccccaacgccggcaucgaccccaauagccgcaucgccgagcggcaggagaucgucgacaacuccaacuggaguggguacuccggcagcuucaucgacuauuggaacgacaacuccgagugcuauaacccgugcuucuacguggagcucauccgcgggcggcccgaggaggccaaguaugugugguggaccucgaacucccugaucgcccugugcggcagccccuuucccgucggguccggcagcuucccggacggcgcgcagauccaguacuucuccuga

SEQ ID NO: 26062 - RNA, 1356 nt, Artificial Sequence; identical to SEQ ID NO: 26045
  derived and/or modified CDS sequence (AUadapt) from InfluenzaA__AGQ81907__NA

SEQ ID NO: 26063 - RNA, 1356 nt, Artificial Sequence
  derived and/or modified CDS sequence (AUadapt) from InfluenzaA__AGQ81908__NA
augaaucccaaccagaagcuguucgcccucucgggcguggccaucgcgcuguccguccugaaccuccugaucgggcugucgaaugugggccucaacgugucccugcaccugaaggagaccgggccgaagcaggaggagaaccugaccugcaugacgaccaaggagaccgagcucggcacccccucguaucugcuccugaacaagucccugugcaacgucgagggguggguggugaucgccaaggacaacgccguccgcuuuggcgagagcgagcagaucaucaucacgcgggagcccuacguguccugcgaccccaacggcuguaagauguacgcccuccaccaggggaccaccauccgcaacaagcacucgaauggcaccauccacgaccggacggccuuccgcgggcugaucuccaccccgcugggcaccccgcccaccgugucgaacuccgacuuuaucugcgucggguggagcuccacgaccugccacgacggcaucggccggaugaccaucuguauccaggggaacaacgacaacgcgaccgccacgguguacuauaaccgccggcucaccaccaccaucaagacgugggcccgcaacauccugcggacccaggagucggagugcgugugccauaacgggaccugcgccgucgugaugaccgacggcuccgcgucgaaccaggcccauacgaaggugauguacuuccacaagggccuggucgugaaggaggaggcccucaagggcuccgccaagcacaucgaggagugcagcuguuacgggcacaaccagaaggugaccugcgucugccgcgauaacuggcagggcgccaaccggcccaucaucgagaucgacaugaacacccuggagcacaccucccgcuaugugugcacggggauccugaccgacaccucgcggcccggcgacaagcccaccggggacuguucgaaccccaucacgggcucccccggcgcgccgggggugaagggcuucggguuccucaacggcgauaacaccuggcuggggcgcaccaucucgccccggucccgcagcggcuucgagaugcugaagauccccaacgccggcaucgaccccaauucccggaucaccgagcgccaggagaucgucgacaacucgaacugguccggguacaguggcuccuucaucgacuacuggaacgacaauagcgagugcuacaacccgugcuuuuacguggagcucauccgggggcgccccgaggaggccaaguacgugugguggacguccaacucgcugaucgcccugugcggcucccccuuucccgucgggucgggcuccuucccggacggcgcccagauccaguacuucagcuga

SEQ ID NO: 26064 - RNA, 1356 nt, Artificial Sequence; identical to SEQ ID NO: 26045
  derived and/or modified CDS sequence (AUadapt) from InfluenzaA__AGQ81909__NA

SEQ ID NO: 26065 - RNA, 1356 nt, Artificial Sequence
  derived and/or modified CDS sequence (AUadapt) from InfluenzaA__AGQ81910__NA
augaaucccaaccagaagcuguucgcccucucgggcguggccaucgcgcuguccguccugaaccuccugaucgggcugaguaacgugggccucaacgugucccugcaccugaaggagaccgggccgaagcaggaggagaaccugaccugcaugacgaccaaggagaccgagcucggcacccccaguuaccugcuccugaacaagucccugugcaacgucgagggguggguggugaucgccaaggauaacgccguccgcuucggcgagucggagcagaucaucaucacgcgggagcccuacguguccugcgaucccaacggcugcaagauguacgcccuccaccaggggaccaccauccgcaacaagcauagcaacggcaccauccacgaccggacggccuuucgcgggcugaucuccaccccgcugggcaccccgcccaccgugucgaacuccgacuucaucugcgucggguggaguuccacgaccugccacgacggcaucggccggaugaccaucugcauccaggggaauaacgacaacgcgaccgccacgguguacuacaaucgccggcucaccaccaccaucaagacgugggcccgcaacauccugcggacccaggagucggagugcgugugccacaaugggaccugcgccgucgugaugaccgacggcuccgcgagcggccaggcccacacgaaggugauguauuuccacaagggccuggucgugaaggaggaggcccucaagggguccgccaagcacaucgaggagugcucguguuacggccacaaccagaaggugaccugcgucugucgcgacaacuggcagggggccaaccggcccaucaucgagaucgacaugaacacccuggagcauaccuccucguacgugugcacgggcauccugaccgacaccagccgccccggggauaagcccaccggcgacugcuccaaccccaucacgggcucgcccggggcgccgggcgugaagggguuuggcuuccucaacggggacaacaccuggcugggccggaccaucagcccccgcucccgguccggcuuugagaugcugaagauccccaacgccgggaucgaccccaacucgcgcaucgccgagcggcaggagaucgucgauaacuccaacuggagcggcuacuccgggucguuuaucgacuacuggaacgacaacuccgaguguuacaacccgugcuucuauguggagcucauccgcggccggcccgaggaggccaaguacgugugguggaccagcaacucccugaucgcccugugcgggucgcccuuucccgucggcuccggcagcuucccggacggggcgcagauccaguacuucuccuga

SEQ ID NO: 26066 - RNA, 1356 nt, Artificial Sequence
  derived and/or modified CDS sequence (AUadapt) from InfluenzaA__AGQ81911__NA
augaaucccaaccagaagcuguucgcccucucgggcguggccaucgcgcuguccguccugaaccuccugaucgggcugaguaacgugggccucaacgugucccugcaccugaaggagaccgggccgaagcaggaggagaaccugaccuguaugacgaccaaggagaccgagcucggcacccccagcuaccugcuccugaacaagucccugugcaacgucgagggguggguggugaucgccaaggauaacgccguccgcuucggcgagucggagcagaucaucaucacgcgggagcccuacguguccugugaccccaacggcugcaagauguacgcccuccaccaggggaccaccauccgcaauaagcacagcaacggcaccauccacgaucggacggccuuccgcgggcugaucuccaccccgcugggcaccccgcccaccgugucgaacuccgacuuuaucugcgucggguggagcuccacgaccugccacgacggcaucggccggaugaccaucuguauccaggggaacaacgacaacgcgaccgccacgguguauuacaaccgccggcucaccaccaccaucaagacgugggcccgcaacauccugcggacccaggagucggagugcgugugucacaacgggaccugcgccgucgugaugaccgacggcuccgcgaguggccaggcccacacgaaggugauguacuuccacaagggccuggucgugaaggaggaggcccucaagggguccgccaagcacaucgaggaguguucgugcuacggccacaaucagaacgugaccugcgucugccgcgacaauuggcagggggccaaccggcccaucaucgagaucgacaugaacacccuggagcacaccucccgcuacguguguacgggcauccugaccgacaccucgcggcccggggacaagcccaccggcgacuguagcaaccccaucacgggcucccccggggcgccgggcgugaagggguucggcuuccucaacggggauaacaccuggcugggccgcaccaucucgccccggucccgcagcggcuucgagaugcugaagauccccaaugccgggaucgaccccaacucccggaucgccgagcgccaggagaucgucgacaacaguaacugguccggcuacagcggguccuucaucgacuauuggaacgacaacucggaguguuacaacccgugcuucuacguggagcucauccggggccgccccgaggaggccaaguaugugugguggaccuccaacagccugaucgcccugugcgggucccccuuccccgucggcaguggcuccuucccggacggggcgcagauccaguacuucagcuga

SEQ ID NO: 26067 - RNA, 1356 nt, Artificial Sequence; identical to SEQ ID NO: 26045
  derived and/or modified CDS sequence (AUadapt) from InfluenzaA__AGQ81912__NA

SEQ ID NO: 26068 - RNA, 1356 nt, Artificial Sequence
  derived and/or modified CDS sequence (AUadapt) from InfluenzaA__AGQ81913__NA
augaaucccaaccagaagcuguucgcccucucgggcguggccaucacccuguccguccugaaccuccugaucgggcugaguaacgugggccucaacgugucccugcaccugaaggagaccgggccgaagcaggaggagaaccucacgugcaugaccaccaaggagaccgagcugggcacgcccaguuaccugcuccugaacaagucccugugcaacgucgagggguggguggugaucgcgaaggauaacgccguccgcuucggcgagucggagcagaucaucaucacccgggagcccuacguguccugcgaucccaacggcugcaagauguacgcccuccaccaggggaccaccauccgcaacaagcauagcaacggcacgauccacgaccggaccgccuuucgcgggcugaucuccaccccgcugggcaccccgcccacggugucgaacuccgacuucaucugcgucggguggaguuccacgaccugccacgacggcaucggccggaugaccaucugcauccaggggaauaacgacaacgccaccgcgaccguguacuacaaucgccggcucaccaccacgaucaagaccugggcccgcaacauccugcggacccaggagagcgagugcgugugccacaaugggaccugcgccgucgugaugacggacggcuccgccucgggccaggcgcacaccaaggugauguauuuccacaagggccuggucgugaaggaggaggcccucaagggguccgccaagcacaucgaggagugcagcuguuacggccacaaccagaaggugaccugcgucugucgcgacaacuggcagggggccaaccggcccaucaucgagaucgacaugaacacccuggagcauacgucccgcuacgugugcaccggcauccugaccgacaccucgcggcccggggacaagcccacgggcgauugcucgaaccccaucaccggcucccccggggccccgggcgugaagggguucggcuuucucaacggggacaacaccuggcugggccgcaccaucagcccccggucccgcucgggcuuugagaugcugaagauccccaacgcggggaucgaccccaacucccggaucgccgagcgccaggagaucgucgacaauagcaacugguccggcuacucgggguccuucaucgauuacuggaacgacaacucggaguguuacaacccgugcuucuauguggagcucauccggggccgccccgaggaggccaaguacgugugguggacguccaacagccugaucgcccugugcgggucccccuuccccgucggcaguggcuccuucccggacggggcccagauccaguacuucagcuga

SEQ ID NO: 26069 - RNA, 1356 nt, Artificial Sequence; identical to SEQ ID NO: 26045
  derived and/or modified CDS sequence (AUadapt) from InfluenzaA__AGQ81914__NA

SEQ ID NO: 26070 - RNA, 1356 nt, Artificial Sequence; identical to SEQ ID NO: 26045
  derived and/or modified CDS sequence (AUadapt) from InfluenzaA__AGQ81915__NA

SEQ ID NO: 26071 - RNA, 1416 nt, Artificial Sequence
  derived and/or modified CDS sequence (AUadapt) from InfluenzaA__AGQ81917__NA
augaaucccaaccagaagcuguucgcccucucgggcguggccaucgcgcuguccguccugaaccuccugaucgggcugucgaacgugggccucaacgugucccugcaccugaaggagaccgggccgaagcaggaggagaaccugaccugcaugacgaucaaccagaacaacaccaccgucguggagaacaccuacgugaacaauacgaccaucaucaccaaggagaccgagcucgagacgcccaacuaccugcuccugaacaagucgcugugcaacgucgagggcugggugguggucgccaaggacaacgccgugcgcuucggggaguccgagcagaucaucgugacccgggagcccuacgucucgugcgaccccaacggcugcaagauguacgcccuccaucagggcaccaccauccgcaacaagcacuccaacgggacgauccacgaccggaccgccuuccgcggccugaucucgaccccgcuggggaccccgcccacgguguccaacucggacuucaucugcgugggcugguccucgacgaccugccacgacgggaucggccggaugaccaucuguauccagggcaacaacgacaacgcgaccgccaccgucuacuacaaccgccggcucaccaccacgaucaagaccugggcccgcaacauccugcggacccaggaguccgagugcgugugccacaacgggaccugcgccguggucaugacggacggcucggcguccucgcaggcccauaccaaggugauguacuuccacaaggggcuggugaucaaggaggaggcccucaagggcuccgccaagcacaucgaggagugcucgugcuacggccacaaccagaaggugaccugcgucugccgcgacaacuggcagggggccaaccggcccaucaucgagaucgacaugaauacccuggagcacacgucccgcuacgugugcaccggcauccugaccgacaccucgcggcccggggacaagcccacgggcgacugcucgaaccccaucaccgggucccccggcgcgccgggcgucaagggguucggcuuccucaacggggacaacaccuggcugggccgcaccaucucgccccggucccgcaguggguucgagaugcugaagauccccaacgccggcaucgaccccaacucccggaucgccgagcgccaggagaucguggacaacucgaacugguccggcuacucgggguccuucaucgacuacuggaacgacaacagugagugcuacaacccgugcuucuacgucgagcucauccggggccgccccgaggaggccaaguacgugugguggaccuccaacucgcugaucgcccugugcgggucccccuuccccgugggcucgggguccuucccggacggcgcgcagauccaguacuucucguga

SEQ ID NO: 26072 - RNA, 1356 nt, Artificial Sequence
  derived and/or modified CDS sequence (AUadapt) from InfluenzaA__AGQ81918__NA
augaaucccaaccagaagcuguucgcccucucgggcguggccaucgcgcuguccguccugaaccuccugaucgggcugaguaacgugggccucaacgugucccugcaccugaaggagaccgggccgaagcaggaggagaaccugaccuguaugacgaccaaggagaccgagcucggcacccccagcuaccugcuccugaacaaggggcugugcaacgucgagggcuggguggugaucgccaaggauaacgccguccgcuucggcgaguccgagcagaucaucaucacgcgggagcccuacgugucgugugaccccaacgggugcaagauguacgcccuccaucagggcaccaccauccgcaacaagcacuccaacgggaccauccacgaccggacggccuuucgcggccugaucagcaccccgcuggggaccccgcccaccguguccaacucggacuuuaucugcgucggcugguccagcacgaccugccacgacggcaucgggcggaugaccaucuguauccagggcaacaacgacaacgcgaccgccacgguguauuacaaccgccggcucaccaccaccaucaagacgugggcccgcaacauccugcggacccaggaguccgagugcgugugucacaacgggaccugcgccgucgugaugaccgacggcucggcguccagucaggcccacacgaaggugauguacuuccacaagggccuggucgugaaggaggaggcccucaagggguccgccaagcauaucgaggagugcucgugcuacggccauaaccagaaggugaccugcgucugccgcgacaacuggcagggggccaaucggcccaucaucgagaucgacaugaacacccuggagcacaccucccgcuacguguguacgggcauccugaccgacaccucgcggcccggggacaagcccaccggcgacugcaguaaccccaucacgggcucccccggggcgccgggcgugaagggguucggcuuccucaacggggauaacaccuggcugggccgcaccaucucgccccggucccgcagcggcuucgagaugcugaagauccccaaugccgggaucgaccccaacucccggaucgccgagcgccaggagaucgucgacaacucgaauugguccggcuacagcggguccuucaucgacuauuggaacgacaacucggaguguuacaacccgugcuucuacguggagcucauccggggccgccccgaggaggccaaguaugugugguggaccuccaacagccugaucgcccugugcgggucccccuuccccgucggcaguggcuccuucccggacggggcgcagauccaguacuucagcuga

SEQ ID NO: 26073 - RNA, 1356 nt, Artificial Sequence; identical to SEQ ID NO: 26045
  derived and/or modified CDS sequence (AUadapt) from InfluenzaA__AGQ81919__NA

SEQ ID NO: 26074 - RNA, 1356 nt, Artificial Sequence; identical to SEQ ID NO: 26045
  derived and/or modified CDS sequence (AUadapt) from InfluenzaA__AGQ81920__NA

SEQ ID NO: 26075 - RNA, 1356 nt, Artificial Sequence
  derived and/or modified CDS sequence (AUadapt) from InfluenzaA__AGQ81921__NA
augaaucccaaccagaagcuguucgcccucucgggcguggccaucgcgcuguccguccugaaccuccugaucgggcugaguaacgugggccucaacgugucccugcaccugaaggagaccgggccgaagcaggaggagaaccugaccuguaugacgaccaaggagaccgagcucggcacccccagcuaccugcuccugaacaagucccugugcaacgucgagggguggguggugaucgccaaggauaacgccguccgcuucggcgagucggagcagaucaucaucacgcgggagcccuacguguccugugaccccaacggcugcaagauguacgcccuccaucaggggaccaccauccgcaacaagcacagcaacggcaccauccacgaucggacggccuuccgcgggcugaucuccaccccgcugggcaccccgcccaccgugucgaacuccgacuuuaucugcgucggguggagcuccacgaccugccacgacggcaucggccggaugaccaucuguauccaggggaacaacgacaacgcgaccgccacgguguauuacaaccgccggcucaccaccaccaucaagacgugggcccgcaacauccugcggacccaggagucggagugugugugccacaacgggaccugcgccgucgugaugaccgacggcuccgcgaguggccaggcccacacgaaggugauguacuuccacaagggccuggucgugaaggaggaggcccucaagggguccgccaagcauaucgaggagugcucgugcuacggccauaaccagaaggugaccugcgucugccgcgacaacuggcagggggccaaucggcccaucaucgagaucgacaugaacacccuggagcacaccucccgcuacguguguacgggcauccugaccgacaccucgcggcccggggacaagcccaccggcgacugcaguaaccccaucacgggcucccccggggcgccgggcgugaagggguucggcuuccucaacggggauaacaccuggcugggccgcaccaucucgccccggucccgcagcggcuucgagaugcugaagauccccaaugccgggaucgaccccaacucccggaucgccgagcgccaggagaucgucgacaacucgaauugguccggcuacagcggguccuucaucgacuauuggaacgacaacucggaguguuacaacccgugcuucuacguggagcucauccggggccgccccgaggaggccaaguaugugugguggaccuccaacagccugaucgcccugugcgggucccccuuccccgucggcaguggcuccuucccggacggggcgcagauccaguacuucagcuga

SEQ ID NO: 26076 - RNA, 1356 nt, Artificial Sequence; identical to SEQ ID NO: 26045
  derived and/or modified CDS sequence (AUadapt) from InfluenzaA__AGQ81922__NA

SEQ ID NO: 26077 - RNA, 1356 nt, Artificial Sequence; identical to SEQ ID NO: 26075
  derived and/or modified CDS sequence (AUadapt) from InfluenzaA__AGQ81923__NA

SEQ ID NO: 26078 - RNA, 1356 nt, Artificial Sequence
  derived and/or modified CDS sequence (AUadapt) from InfluenzaA__AGQ81924__NA
augaaucccaaccagaagcuguucgcccucucgggcguggccaucgcgcuguccguccugaaccuccugaucgggcugaguaacgugggccucaacgugucccugcaccugaaggagaccgggccgaagcaggaggagaaccugaccugcaugacgaccaaggagaccgagcucggcacccccaguuaccugcuccugaacaagucccugugcaacgucgagggguggguggugaucgccaaggacaaugccguccgcuucggcgagucggagcagaucaucaucacgcgggagcccuacguguccugcgaccccaauggcugcaagauguacgcccuccaccaggggaccaccauccgcaacaagcacaguaacggcaccauccacgaccggacggccuuccgcgggcugaucuccaccccgcugggcaccccgcccaccgugagcaauuccgacuucaucugcgucggguggucguccacgaccugccaugacggcaucggccggaugaccaucugcauccaggggaacaacgacaaugcgaccgccacgguguacuacaaccgccggcucaccaccaccaucaagacgugggcccgcaacauccugcggacccaggagucggagugugugugccacaacgggaccugcgccgucgugaugaccgacggcuccgcgaauagccaggcccacacgaaggugauguacuuccacaagggccuggucgugaaggaggaggcccucaagggcuccgccaagcauaucgaggagugcucgugcuacgggcauaaccagaaggugaccugcgucugccgcgacaacuggcagggcgccaaucggcccaucaucgagaucgacaugaacacccuggagcacaccucccgcuacgugugcacggggauccugaccgauaccucgcggcccggcgacaagcccaccggggacugcagcaaucccaucacgggcucccccggcgcgccgggggugaagggcuucggguuccucaacggcgacaacaccuggcuggggcgcaccaucaguccccggucccgcucgggcuucgagaugcugaagauccccaacgccggcaucgaccccaacucccggaucgccgagcgccaggagaucgucgauaacagcaacugguccggguacucgggcuccuuuaucgacuacuggaacgacaacagugagugcuacaacccgugcuucuauguggagcucauccgggggcgccccgaggaggccaaguacgugugguggaccuccaacagccugaucgcccugugcggcucccccuuccccgucgggaguggcuccuucccggacggcgcgcagauccaguacuucagcuga

SEQ ID NO: 26079 - RNA, 1356 nt, Artificial Sequence; identical to SEQ ID NO: 26045
  derived and/or modified CDS sequence (AUadapt) from InfluenzaA__AGQ81925__NA

SEQ ID NO: 26080 - RNA, 1356 nt, Artificial Sequence; identical to SEQ ID NO: 26045
  derived and/or modified CDS sequence (AUadapt) from InfluenzaA__AGQ81926__NA

SEQ ID NO: 26081 - RNA, 1356 nt, Artificial Sequence; identical to SEQ ID NO: 26045
  derived and/or modified CDS sequence (AUadapt) from InfluenzaA__AGQ81927__NA

SEQ ID NO: 26082 - RNA, 1356 nt, Artificial Sequence; identical to SEQ ID NO: 26045
  derived and/or modified CDS sequence (AUadapt) from InfluenzaA__AGQ81928__NA

SEQ ID NO: 26083 - RNA, 1356 nt, Artificial Sequence; identical to SEQ ID NO: 26045
  derived and/or modified CDS sequence (AUadapt) from InfluenzaA__AGQ81929__NA

SEQ ID NO: 26084 - RNA, 1413 nt, Artificial Sequence
  derived and/or modified CDS sequence (AUadapt) from InfluenzaA__AGQ81930__NA
augaaucccaaccagaagaucaucaccaucggcucgaucucccuggggcucguggucuucaacgugcugcugcacguggucagcaucaucgugaccgugcucguccugggccgcgggggcaacuccgggaucugcaacgagacgguggugcgggaguacaacgagaccguccgcaucgagaagaucacccaguggcacaacaccagcgugguggaguacgucccguacugguccgagggcaacuauaugaacaacacggaggccaucugcgacgugaagggcuucgcccccuucagcaaggacaacgggauccggaucggcucccgcgggcacguguucgucauccgggagcccuucgugagcugcucccccaccgagugccgcaccuucuuccugacccagggcagucuccugaacgacaagcacuccaacgggacggugaaggaccggagcccguuccgcacccugauguccgucgaggugggccagagccccaacguguaccaggcgcgguucgaggccgucgccugguccgccaccgccugccacgacggcaagaaguggaugaccaucggggugacgggccccgacagcaaggcgguggccgucgugcacuaugggggcguccccaccgacguggugaacuccugggccggcgacauccuccgcacccaggagagcuccugcacgugcauccaggggaacugcuacugggucaugaccgacggcccggccaaccggcaggcgcaguaccgcaucuacaaggccaaccaggggaagaucgugggccagaccgacaucagcuucaaugggggccacaucgaggagugcagcugcuaccccaacgacggcaagguggagugcgucugccgggacaacuggaccgggaccaaccgccccgugcuggugaucucccccgaccugagcuaccgggucggcuaccucugcgccgggcugccguccgauacgccccgcggcgaggacgcccaguucaccgggagcugcaccucccccaugggcaaccagggcuacggggugaagggcuucggguuccggcagggcaccgacguguggauggggcgcacgaucagccggaccucccgcagcggcuucgagauccugcggaucaagaacggcuggacccagaccuccaaggagcagguccgcaagcaggucgugguggacaaccucaacuggagcggguauuccggcagcuucacgcugcccguggagcuguccgggaaggacugccucgugccgugcuucugggucgagaugauccgcggcaagcccgaggagaagaccaucuggaccagcuccagcuccaucgugaugugcggcguggacuacgaggucgccgacuggagcuggcacgacggggcgauccugcccuucgacaucgacaagauguga

SEQ ID NO: 26085 - RNA, 1413 nt, Artificial Sequence
  derived and/or modified CDS sequence (AUadapt) from InfluenzaA__AGQ81931__NA
augaaccccaaccagaagaucaucaccaucggcucgcugucccucgggcuggugguccugaacauccuccugcacaucaucucgaucaccaucacggugcuggugaucccgcgcaacggcaacaccggguccugcaacgagaccgucauccgggaguacaacgagaccgugcgcaucgagaagaucacgcaguggcacaacaccaacaucaucgaguacaucgagaagcccgagaacgaccucuucaugaacaacaccggcccccugugcgacgccaagggguucgcccccuucucgaaggacaacggcauccggaucggcuccaaggggcacguguucgucauccgcgagccguucgugagcugcucccccaccgagugccggacguucuuccugacccagggcucgcuccugaacgacaagcacuccaacgggaccgugaaggaccgcucgcccuaccggacccugauguccgucgagaucggccagagccccaacguguaccaggcgcgcuucgaggccguggccugguccgccacggccugccacgacgggaagaaguggaugaccaucggcgucaccggcccggacgcgaaggccguggccgugguccacuacgggggcauccccaccgacgugaucaacucgugggccggggacauccuccggacgcaggaguccucgugcacgugcauccagggcgagugcuacugggugaugaccgacggccccgcgaaccgccaggcccaguaccgggccuucaaggccaagcaggggaagaucaucggccagaccgagaucuccuucaacgggggccacaucgaggagugcagcugcuaccccaacgaggggaaggucgagugcgugugccgcgacaacuggaccggcaccaaccggccggugcuggucaucuccucggaccugucguaccgcgugggcuaccucugcgccgggcugcccuccgacacgccccggggcgaggacucgcaguucaccggguccugcaccagccccaugggcaaccagggguacggcgugaagggcuucggguuccgccagggcaacgacgucuggauggggcggaccaucucccgcaccucgcgguccggcuucgagauccugaagauccgcaacggguggauccagaacucgaaggagcagaucaagcgccagguggucguggacaacuccaacuggagcggcuacuccggcucguucacccucccgguggagcugacgcggcgcaacugccugguccccugcuucuggguggagaugauccgggggaagcccgaggagaagaccaucuggaccuccucguccagcaucgugaugugcggcgucgaccacgagaucgcgaacugguccuggcacgacggggccauccuccccuucgacaucgacaagauguga

SEQ ID NO: 26086 - RNA, 1413 nt, Artificial Sequence
  derived and/or modified CDS sequence (AUadapt) from InfluenzaA__AGQ81932__NA
augaaucccaaccagaagaucaucaccaucggcucgaucucccuggggcucguggucuucaacgugcugcugcacguggucagcaucaucgugaccgugcucauccugggccgcgggggcaacaacgggaucugcaacgagacggucgugcgggaguacaacgagaccgugcgcaucgagaagaucacccaguggcacaacaccuccgucguggaguacgugccguacuggaacgagggcacguacaugaacaacaccgaggccaucugcgacgucaagggcuucgcccccuucagcaaggacaacgggauccggaucggcucccgcgggcacguguucgugauccgggagcccuucgucagcugcucccccaccgagugccgcaccuucuuccugacgcagggcucgcuccugaacgacaagcacuccaacgggaccgugaaggaccggaguccguuccgcacccugauguccguggaggucggccagagccccaacguguaccaggcgcgguucgaggccguggccugguccgccaccgccugccacgacggcaagaaguggaugacgaucggggucaccggcagcgacuccaaggcgguggccgugguccacuacgggggcgugcccaccgacgucgugaacucgugggccggcgacauccuccgcacccaggaguccagcugcacgugcauccaggggaacugcuacugggugaugaccgacggccccgccaaccggcaggcgcaguaccgcaucuacaaggccaaccaggggaaggucaucggccagaccgacaucuccuucaacgggggccacaucgaggagugcagcugcuacccgaacgacggcaagguggagugcgugugccgggacaacuggaccgggacgaaccgccccguccuggugaucagucccgaccuguccuaccgggugggcuaccucugcgccgggcugcccucggacaccccgcgcggcgaggacgcccaguucaccggguccugcaccagccccaugggcaaccagggcuacggggucaagggcuucggguuccggcagggcacggacguguggauggggcgcaccaucucccagaccagccgguccggcuucgagauccugcgcgugaagaacggcuggacccagacgagcaaggagcagguccggaagcaggucgugguggacaaccucaacugguccggguacucgggcuccuucacccugcccaucgagcugagcgggaaggacugccucgugcccugcuucuggguggagaugauccgcggcaagccggaggagaaguccaucuggaccagcuccagcuccaucgucaugugcggcguggacuacgagguggccgacuggagcuggcacgacggggcgauccugcccuucgacaucgacaagauguga

SEQ ID NO: 26087 - RNA, 1413 nt, Artificial Sequence
  derived and/or modified CDS sequence (AUadapt) from InfluenzaA__AGQ81934__NA
augaaucccaaccagaagauccugugcaccucggccaccgccaucgugaucggcacgaucgcgguccucaucgggaucgccaaccugggccugaacaucgggcuccaccugaagccguccugcaacugcucgcacucccagcccgagaccaccaacaccucgcagacgaucaucaacaacuacuacaacgagaccaacaucacccagaucuccaacaccaacauccagauggaggagcgcgccucgcgggacuuuaacaaccugacgaagggccucugcaccaucaacuccuggcacaucuacgggaaggacaacgccgugcgcaucggcgagaacucggacgugcuggucacccgggagcccuacguguccugcgaccccgacgagugccgcuucuacgcccugucgcagggcaccacgauccgggggaagcacuccaacggcaccauccacgaccgcagucaguaccgggcgcucaucuccuggccgcugucguccccgcccaccguguacaacucgcgcgucgagugcaucgggugguccucgaccuccugccacgacggcaagucgcggaugucgaucugcaucuccgggcccaacaacaacgccucggccguggugugguacaaccgccggcccgucgccgagaucaacacgugggcgcgcaacauccugcggacccaggaguccgagugcgugugccauaacggcgugugccccgucguguucaccgacggcucggccaccgggcccgccgacacgcgcaucuacuacuucaaggagggccggauccucaagugggagucccugaccgggaccgccaagcacaucgaggagugcucgugcuacggcgagcgcaccggcaucacgugcacgugccgggacaacuggcagggguccaaccgccccgugauccggaucgacccggucgccaugacccacaccucgcaguacaucuguucccccgugcugaccgacaacccccgccccaacgacccgaacgugggcaagugcaacgaccccuaccccgggaacaacaacaacggcgucaagggguucucguaccucgacggcgugaacaccuggcugggccggaccaucuccaccgcgucgcgcuccggguacgagaugcugaaggugcccaacgcccucacggacgaccgcaguaagccgauccagggccagaccaucguccugaacaccgacugguccggguacucgggcuccuucauggacuacugggccgagggggacugcuaccgggccugcuucuacguggagcugauccgcggccggcccaaggaggacaaggugugguggaccucgaacuccaucgucucgaugugcucguccacggaguuccucggccagugggacuggcccgacggggccaagaucgaguacuuccuguga

SEQ ID NO: 26088 - RNA, 1413 nt, Artificial Sequence; identical to SEQ ID NO: 26087
  derived and/or modified CDS sequence (AUadapt) from InfluenzaA__AGQ81935__NA

SEQ ID NO: 26089 - RNA, 1413 nt, Artificial Sequence; identical to SEQ ID NO: 26087
  derived and/or modified CDS sequence (AUadapt) from InfluenzaA__AGQ81936__NA

SEQ ID NO: 26090 - RNA, 1413 nt, Artificial Sequence; identical to SEQ ID NO: 26087
  derived and/or modified CDS sequence (AUadapt) from InfluenzaA__AGQ81937__NA

SEQ ID NO: 26091 - RNA, 1413 nt, Artificial Sequence; identical to SEQ ID NO: 26087
  derived and/or modified CDS sequence (AUadapt) from InfluenzaA__AGQ81938__NA

SEQ ID NO: 26092 - RNA, 1413 nt, Artificial Sequence; identical to SEQ ID NO: 26087
  derived and/or modified CDS sequence (AUadapt) from InfluenzaA__AGQ81939__NA

SEQ ID NO: 26093 - RNA, 1413 nt, Artificial Sequence
  derived and/or modified CDS sequence (AUadapt) from InfluenzaA__AGQ81940__NA
augaaucccaaccagaagauccugugcaccucggccaccgccaucaucaucggcgcgaucgccgugcucaucgggaucgccaaccugggccugaacaucgggcuccaccugaagccguccugcaacugcucgcacucccagcccgagacgaccaacaccucgcagaccaucaucaacaacuacuacaacgagacgaacaucacccagaucuccaacaccaacauccagauggaggagcgcgccucgaagggcuucaauaaccugaccaaggggcucugcacgaucaacuccuggcacaucuacggcaaggacaacgccguccggaucggcgagucguccgacgugcuggugacccgcgagcccuacgucucgugcgaccccgacgagugccgguucuacgcgcugucccaggggaccaccauccgcggcaagcacucgaacgggacgauccacgaccggucccaguaccgcgcccucaucaguuggccgcuguccucgccgcccaccguguacaacucccggguggagugcaucggcuggucguccaccucgugccacgacggcaagucgcgcauguccaucugcaucucggggcccaacaacaacgccuccgccgucgugugguacaaccggcgccccguggcggagaucaacaccugggcccggaacauccugcgcacgcaggagucggagugcgucugccacaauggcgugugccccguggucuucaccgacggguccgccaccggccccgccgacacccggaucuacuacuucaaggaggggaagauccucaagugggagucgcuggccggcacggcgaagcacaucgaggagugcuccugcuacggcgagcgcaccgggaucacgugcacgugccgggacaacuggcagggcucgaaccgccccgugauccagaucgacccgguggccaugacccacaccucccaguacaucugcucgcccguccugaccgauaacccccggcccaacgacccgaacaucgggaagugcaacgaccccuaccccggcaacaacaacaacggggugaagggcuucuccuaccucgacggcgccaacaccuggcuggggcgcaccaucucgaccgccucccggucgggcuacgagaugcugaaggugcccaacgcccucaccgacgaccgcuccaagccgauccaggggcagaccaucguccugaacacggauuggucgggcuacuccgggucguucauggacuacugggcggagggcgacugcuaccgggccugcuucuacguggagcugauccgcggccgccccaaggaggacaaggugugguggaccuccaacucgaucgucucgaugugcuccucgaccgaguuccucgggcaguggaacuggcccgacggcgccaagaucgaguacuuccuguga

SEQ ID NO: 26094 - RNA, 1413 nt, Artificial Sequence
  derived and/or modified CDS sequence (AUadapt) from InfluenzaA__AGQ81941__NA
augaaucccaaccagaagauccugugcaccucggccaccgccaucaucaucggcacgaucgcggugcucaucggggucgccaaccugggccugaacaucgggcuccaccugaagccgggcugcaacugcucccacucgcagcccgaggccaccaacaccucccagaccaucaucaacaacuacuacaacgagacgaauaucacccagaucucgaacaccaacauccagauggaggagcgccccaaccggggguucaacaaccugaccaagggccucugcacgaucaacuccuggcacaucuacggcaaggacaacgccgugcgcaucggggagaacucggacgugcuggucacccgggagcccuacguguccugugacccggacgagugccgcuucuacgcccugucgcagggcaccaccauccgggggaagcacuccaacggcacgauccacgaccgcucgcaguaccgggcgcucaucuccuggccccugucguccccgcccaccguguacaacucgcgcgucgagugcaucgggugguccaguaccuccugccacgacggcaagucgcggauguccaucugcaucucgggccccaacaacaacgccucggccguggugugguacaaccgccggcccgucgccgagaucaacaccugggcgcgcaacauccugcggacgcaggaguccgagugcgugugccacaauggggugugccccgucguguucaccgacggcucggccaccgggcccgccgacacccgcguguacuacuuccgggagggcaagauccucaagugggagucccugacgggcaccgcccgccacaucgaggagugcucgugcuacggggagcggaccggcaucacgugcacgugccgcgacaacuggcagggguccaaucggccggucauccagaucgaccccguggccaugacccacaccucgcaguacaucugcucccccgugcugaccgacaacccccgcccgaacgaccccaacgucggcaagugcaacgaccccuaccccgggaacaacaacaauggcgugaagggcuucucguaccucgacggggugaacaccuggcugggccggaccaucuccaccgcgucgcgcuccggguacgagaugcugaaggucccgaacgcccucaccgacgaccgcucgaagcccauccagggccagacgaucgugcugaacaccgacugguccggguacucgggcuccuucauggacuauugggccgagggcgacugcuaccgggccugcuucuacguggagcugauccgcgggcggcccaaggaggacaaggucugguggaccucgaacuccaucgugucgaugugcuccucgaccgaguuccucggccagugggacuggcccgacggggccaagaucgaguacuuccuguga

SEQ ID NO: 26095 - RNA, 1413 nt, Artificial Sequence
  derived and/or modified CDS sequence (AUadapt) from InfluenzaA__AGQ81942__NA
augaaucccaaccagaagauccugugcaccucggccaccgccaucaucaucggcacgaucgcggugcucaucggggucgccaaccugggccugaacaucgggcuccaccugaagccgggcugcaacugcucccacucgcagcccgaggccaccaacaccucccagaccaucaucaacaacuacuacaacgagacgaacaucacccagaucucgaauaccaacauccagauggaggagcgccccucccggggguucaacaaccugaccaagggccucugcacgaucaacucguggcacaucuacggcaaggacaacgccgugcgcaucggggagaacuccgacgugcuggucacccgggagcccuacgugucgugcgacccggacgagugccgcuucuaugcccugucccagggcaccaccauccgggggaagcacucgaacggcacgauccacgaccgcucccaguaccgggcgcucaucucguggccccuguccucgccgcccaccguguacaacucccgcgucgagugcaucggguggucguccaccucgugccacgacggcaagucccggaugucgaucugcaucucgggccccaauaacaacgccuccgccaucgugugguacaaccgccggcccguggccgagaucaacaccugggcgcgcaacauccugcggacgcaggagucggagugcgucugccacaacggggugugccccguggucuucaccgacggcuccgccaccgggcccgccgacacccgcguguacuacuuccgggagggcaagauccucaagugggagucgcugacgggcaccgcccgccacaucgaggaguguuccugcuacggggagcggaccggcaucacgugcacgugccgcgacaacuggcaggggucgaaccggccggugauccagaucgaccccgucgccaugacccacaccucccaguacaucugcucgcccgugcugaccgacaacccccgcccgaacgaccccaacgugggcaagugcaaugaccccuaccccgggaacaacaacaacggcgucaagggcuucuccuaccucgacggggugaacaccuggcugggccggaccaucucgaccgcgucccgcucgggguacgagaugcugaaggugccgaacgcccucaccgacgaccgcuccaagcccauccagggccagacgaucauccugaacaccgacuggucgggguacuccggcaguuucauggacuacugggccgagggcgacugcuaccgggccugcuucuacgucgagcugauccgcgggcggcccaaggaggacaaggugugguggaccuccaacucgaucguguccaugugcucgucgaccgaguuccucggccagugggacuggcccgacggggccaagaucgaguacuuccuguga

SEQ ID NO: 26096 - RNA, 1413 nt, Artificial Sequence
  derived and/or modified CDS sequence (AUadapt) from InfluenzaA__AGQ81943__NA
augaaucccaaccagaagauccugugcaccucggccaccgccaucaucaucggcgcgaucgccgugcucaucgggaucgccaaccugggccugaacaucgggcuccaccugaagccguccugcaacugcucgcacucccagcccgagacgaccaacaccucgcagaccaucaucaacaacuacuacaacgagacgaacaucacccagaucuccaacaccaacauccagauggaggagcgcaccucgcggggcuucaauaaccugacgaaggggcucugcaccaucaacuccuggcacaucuacggcaaggacaacgccauccgcaucggcgagucguccgacguccuggugacccgggagcccuacgugucgugcgaccccgacgagugccgcuucuacgcccugucccaggggaccacgauccggggcaagcacucgaacgggaccauccacgaccgcucccaguaccgggcgcucaucaguuggccgcuguccucgccgcccaccgucuacaacucccgcguggagugcaucggcuggucguccaccucgugccacgacggcaagucgcggauguccaucugcaucucggggcccaacaacaacgccuccgccguggucugguacaaccgccggcccguggccgagaucaacacgugggcgcgcaacauccugcggacccaggagucggagugcgugugccacaauggcgucugccccgugguguucaccgacggguccgccaccggccccgccgacacgcgcaucuacuacuucaaggaggggcggauccucaagugggagucgcugaccggcaccgccaagcacaucgaggagugcuccugcuacggcgagcgcaccgggaucacgugcacgugccgggacaacuggcagggcucgaaccgccccgucauccagaucgacccgguggccaugacccacaccucccaguacaucugcucgcccgugcugaccgauaacccccggcccaacgacccgaacaucgggaagugcaacgaccccuaccccggcaacaacaacaacggggucaagggcuucuccuaccucgacggcgcgaacaccuggcuggggcgcaccaucucgaccgccucccggucgggcuacgagaugcugaaggugcccaacgcccucacggacgaccgcuccaagccgauccaggggcagaccaucgugcugaacaccgauuggucgggcuacuccgggucguucauggacuacugggccgagggcgacugcuaccgcgccugcuucuacgucgagcugauccggggccgccccaaggaggacaaggugugguggaccuccaacucgaucgugucgaugugcuccucgacggaguuccucgggcaguggaacuggcccgacggcgcgaagaucgaguacuuccuguga

SEQ ID NO: 26097 - RNA, 1413 nt, Artificial Sequence; identical to SEQ ID NO: 26087
  derived and/or modified CDS sequence (AUadapt) from InfluenzaA__AGQ81944__NA

SEQ ID NO: 26098 - RNA, 1413 nt, Artificial Sequence
  derived and/or modified CDS sequence (AUadapt) from InfluenzaA__AGQ81947__NA
augaaucccaaccagaagauccugugcaccucggccaccgcccucgugaucggcacgaucgcgguccugaucgggaucgccaaccugggccucaacaucgggcugcaccugaagccguccugcaacugcucgcacucccagcccgaggccaccaacaccucgcagaccaucaucaacaacuacuacaacgagacgaacaucacccagaucuccaacaccaacauccagauggaggagcgcgccucgcgguccuucaacaaccucaccaagggccugugcacgaucaacucguggcauaucuacgggaaggacaacgccauccgcaucggcgagaacuccgacgugcuggugacccgggagcccuacgucucgugcgaccccgacgagugccgcuucuacgcgcucucccagggcaccaccauccgggggaagcacucgaacggcacgauccacgaccgcucccaguaccgggcccugaucucguggccgcuguccucgccgcccaccguguacaacucccgcguggagugcaucggguggucguccaccucgugccacgauggcaagucgcggauguccaucugcaucucggggcccaacaacaacgccuccgccgucgugugguacaaccgccggcccguggcggagaucaacaccugggcccgcaacauccuccggacgcaggagucggagugcgucugccacaacggcgugugccccguggucuucaccgacggcuccgccaccgggcccgccgacacccgcaucuacuacuucaaggagggcaagauccugaagugggagucgcugacggggaccgccaagcacaucgaggagugcuccugcuacggcgagcggaccggcaucacgugcacgugucgcgacaacuggcaggggucgaaccggcccgugauccagaucgacccgguggcgaugacccacaccucccaguacaucugcucgcccguccucaccgacaacccccgccccaacgacccgaacgugggcaagugcaacgaccccuaccccgggaacaacaacaacggcgugaagggguucuccuaccuggacggcgucaacaccuggcugggccggaccaucucgaccgccucccgcucgggguaugagaugcucaaggugcccaacgcccugaccgacgaccgguccaagccgauccagggccagacgaucgugcugaacaccgacuggucgggguacuccggcucguucauggacuacugggccgagggggacugcuaccgcgccugcuucuacgucgagcucauccgcggccggcccaaggaggacaaggugugguggaccuccaacucgaucgugucgaugugcuccucgaccgaguuccugggccaguggaacuggcccgacggggcgaagaucgaguacuuccuguga

SEQ ID NO: 26099 - RNA, 1413 nt, Artificial Sequence
  derived and/or modified CDS sequence (AUadapt) from InfluenzaA__AGQ81948__NA
augaaucccaaccagaagauccugugcaccucggccaccgccaucaucaucggcgcgaucgccgugcucaucgggaucgccaaccugggccugaacaucgggcuccaccugaagccguccugcaacugcucgcacucccagcccgagacgaccaacaccucgcagaccaucaucaacaacuacuacaacgagacgaacaucacccagaucuccaacaccaacauccagauggaggagcgcaccucgcggggcuuuaacaaccugacgaaggggcucugcaccaucaacuccuggcacaucuacggcaaggacaacgccauccgcaucggcgagucguccgacguccuggugacccgggagcccuacgugucgugcgaccccgacgagugccgcuucuacgcccugucccaggggaccacgauccggggcaagcacucgaacgggaccauccacgaccgcucccaguaucgggcgcucaucucguggccgcuguccucgccgcccaccgucuacaacucccgcguggagugcaucggcuggucguccaccucgugccacgacggcaagucgcggauguccaucugcaucucggggcccaacaacaacgccuccgccguggucugguacaaccgccggcccguggccgagaucaacacgugggcgcgcaacauccugcggacccaggagucggagugcgugugccauaacggcgucugccccgugguguucaccgacggguccgccaccggccccgccgacacgcgcaucuacuacuucaaggaggggcggauccucaagugggagucgcugaccggcaccgccaagcacaucgaggagugcuccugcuacggcgagcgcaccgggaucacgugcacgugccgggacaacuggcagggcucgaaccgccccgucauccagaucgacccgguggccaugacccacaccucccaguacaucugcagucccgugcugaccgacaacccccggcccaacgacccgaacaucgggaagugcaacgaccccuaccccggcaacaacaacaacggggucaagggcuucuccuaccucgacggcgcgaacaccuggcuggggcgcaccaucucgaccgccucccggucgggcuacgagaugcugaaggugcccaacgcccucacggacgaccgcuccaagccgauccaggggcagaccaucgugcugaauaccgacuggucgggcuacuccgggucguucauggacuacugggccgagggcgagugcuaccgcgccugcuucuacgucgagcugauccggggccgccccaaggaggacaaggugugguggaccuccaacucgaucgugucgaugugcuccucgacggaguuccucgggcaguggaacuggcccgacggcgcgaagaucgaguacuuccuguga

SEQ ID NO: 26100 - RNA, 1413 nt, Artificial Sequence
  derived and/or modified CDS sequence (AUadapt) from InfluenzaA__AGQ81951__NA
augaaucccaaccagaagauccugugcaccucggccaccgccaucgugaucggcacgaucgcgguccucaucgggguggccaaccugggccugaacaucgggcuccaccugaagccgggcugcaacugcucccagucgcagcccgaggccaccaacaccucccagaccaucaucaacaacuacuacaacgagacgaauaucacccagaucucgaacaccaacauccagauggaggagcgcgccaaccggggguucaacaaccugaccaagggccucugcacgaucaacuccuggcacaucuacggcaaggacaacgccgugcgcaucggggagaacucggacguccuggugacccgggagcccuacguguccugugaccccgacgagugccgcuucuacgcgcugucgcagggcaccaccauccgggggaagcacuccaacggcacgauccacgaccgcucgcaguaccgggcccucaucuccuggccgcugucguccccgcccaccgucuacaacucgcgcguggagugcaucgggugguccaguaccuccugccacgacggcaagucgcggauguccaucugcaucucgggccccaacaacaacgccucggccguggucugguacaaccgccggcccguggcggagaucaacaccugggcccgcaacauccugcggacgcaggaguccgagugcgugugccacaauggggucugccccgugguguucaccgacggcucggccaccgggcccgccgacacccgcgucuacuacuuccgggagggcaagauccucaagugggagucccugacgggcaccgccaagcacaucgaggagugcucgugcuacggggagcgcaccggcaucacgugcacgugccgggacaacuggcagggguccaaucgccccgugauccagaucgacccgguggcgaugacccacaccucgcaguacaucugcucccccguccugaccgacaacccccggcccaacgacccgaacgugggcaagugcaacgaccccuaccccgggaacaacaacaauggcgugaagggcuucucguaccucgacggggucaacaccuggcugggccgcaccaucuccaccgccucgcgguccggguacgagaugcugaaggugcccaacgcccucaccgacgaccgcucgaagccgauccagggccagacgaucgugcugaacaccgacugguccggguacucgggcuccuucauggacuauugggccgagggcgacugcuaccgcgccugcuucuacgucgagcugauccgggggcgccccaaggaggacaaggugugguggaccucgaacuccaucgucucgaugugcuccucgaccgaguuccucggccaguggaacuggcccgacggggcgaagaucgaguacuuccuguga

SEQ ID NO: 26101 - RNA, 1413 nt, Artificial Sequence
  derived and/or modified CDS sequence (AUadapt) from InfluenzaA__AGQ81952__NA
augaaucccaaccagaagauccugugcaccucggccaccgccaucgugaucggcacgaucgcgguccucaucgggguggccaaccugggccugaacaucgggcuccaccugaagccgggcugcaacugcucccacucgcagcccgaggccaccaacaccucccagaccaucaucaacaacuacuacaacgagacgaauaucacccagaucucgaacaccaacauccagauggaggagcgcgccaaccggggguucaacaaccugaccaagggccucugcacgaucaacuccuggcacaucuacggcaaggacaacgccgugcgcaucggggagaacucggacguccuggugacccgggagcccuacguguccugugaccccgacgagugccgcuucuacgcgcugucgcagggcaccaccauccgggggaagcacuccaacggcacgauccacgaccgcucgcaguaccgggcccucaucuccuggccgcugucguccccgcccaccgucuacaacucgcgcguggagugcaucgggugguccaguaccuccugccacgacggcaagucgcggauguccaucugcaucucgggccccaacaacaacgccucggccguggucugguacaaccgccggcccguggcggagaucaacaccugggcccgcaacauccugcggacgcaggaguccgagugcgugugccacaauggggucugccccgugguguucaccgacggcucggccaccgggcccgccgacacccgcgucuacuacuuccgggagggcaagauccucaagugggagucccugacgggcaccgccaagcacaucgaggagugcucgugcuacggggagcgcaccggcaucacgugcacgugccgggacaacuggcagggguccaaucgccccgugauccagaucgacccgguggcgaugacccacaccucgcaguacaucugcucccccguccugaccgacaacccccggcccaacgacccgaacgugggcaagugcaacgaccccuaccccgggaacaacaacaauggcgugaagggcuucucguaccucgacggggucaacaccuggcugggccgcaccaucuccaccgccucgcgguccggguacgagaugcugaaggugcccaacgcccucaccgacgaccgcucgaagccgauccagggccagacgaucgugcugaacaccgacugguccggguacucgggcuccuucauggacuauugggccgagggcgacugcuaccgcgccugcuucuacgucgagcugauccgggggcgccccaaggaggacaaggugugguggaccucgaacuccaucgucucgaugugcuccucgaccgaguuccucggccaguggaacuggcccgacggggcgaagaucgaguacuuccuguga

SEQ ID NO: 26102 - RNA, 1413 nt, Artificial Sequence
  derived and/or modified CDS sequence (AUadapt) from InfluenzaA__AGQ81954__NA
augaaucccaaccagaagauccugugcaccucggccaccgccaucgugaucggcacgaucgcgguccucaucgggguggccaaccugggccugaacaucgggcuccaccugaagccguccugcaacugcucgcacucccagcccgaggccaccaacaccucgcagaccaucaucaacaacuacuacaacgagacgaacaucacccagaucuccaacaccaacauccagauggaggagcgcgccucgcggggcuucaauaaccugaccaaggggcucugcacgaucaacuccuggcacaucuacggcaaggacaacgccgugcgcaucggcgagaacucggacguccuggugacccgggagcccuacguguccugcgaccccgacgagugccgcuucuacgcgcugucgcaggggaccaccauccggggcaagcacuccaacgggacgauccacgaccgcucgcaguaucgggcccucaucuccuggccgcugucguccccgcccaccgucuacaacucgcgcguggagugcaucggcugguccucgaccuccugccacgacggcaagucgcggaugucgaucugcaucuccgggcccaacaacaacgccucggccguggucugguacaaccgccggcccguggcggagaucaacaccugggcccgcaacauccugcggacgcaggaguccgagugcgugugccacaauggcgucugccccgugguguucaccgacgggucggccaccggccccgccgacacccgcgucuacuacuucaaggaggggaagauccucaagugggagucccugacgggcaccgccaagcacaucgaggagugcucgugcuacggcgagcggaccgggaucacgugcacgugccgcgacaacuggcagggcuccaaccggcccgugauccagaucgacccgguggcgaugacccacaccucgcaguacaucugcucccccguccugaccgauaacccccgccccaacgacccgaacguggggaagugcaacgaccccuaccccggcaacaacaacaacggggugaagggcuucucguaccucgacggcgucaacaccuggcuggggcggaccaucuccaccgccucgcgcuccggcuacgagaugcugaaggugcccaacgcccucaccgacgaccggucgaagccgauccaggggcagacgaucgugcugaauaccgacugguccggcuacucgggguccuucauggacuacugggccgagggcgacugcuaccgcgccugcuucuacgucgagcugauccgcggccggcccaaggaggacaaggugugguggaccucgaacuccaucgucucgaugugcucguccaccgaguuccucgggcaguggaacuggcccgacggcgcgaagaucgaguacuuccuguga

SEQ ID NO: 26103 - RNA, 1413 nt, Artificial Sequence
  derived and/or modified CDS sequence (AUadapt) from InfluenzaA__AGQ81956__NA
augaaucccaaccagaagauccugugcaccucggccaccgccaucgugaucggcacgaucgcgguccucaucgggguggccaaccugggccugaacaucgggcuccaccugaagccguccugcaacugcucgcacucccagcccgaggccaccaacaccucgcagaccaucaucaacaacuacuacaacgagacgaacaucacccagaucuccaacaccaacauccagauggaggagcgcgccucgcggggcuucaauaaccugaccaaggggcucugcacgaucaacuccuggcacaucuacggcaaggacaacgccgugcgcaucggcgagaacucggacguccuggugacccgggagcccuacguguccugcgaccccgacgagugccgcuucuacgcgcugucgcaggggaccaccauccggggcaagcacuccaacgggacgauccacgaccgcucgcaguaucgggcccucaucuccuggccgcugucguccccgcccaccgucuacaacucgcgcguggagugcaucggcugguccucgaccuccugccacgacggcaagucgcggaugucgaucugcaucuccgggcccaacaacaacgccucggccaucgugugguacaaccgccggcccgucgcggagaucaacaccugggcccgcaacauccugcggacgcaggaguccgagugcgugugccacaauggcgugugccccgucguguucaccgacgggucggccaccggccccgccgacacccgcguguacuacuucaaggaggggaagauccucaagugggagucccugacgggcaccgccaagcacaucgaggagugcucgugcuacggcgagcggaccgggaucacgugcacgugccgcgacaacuggcagggcuccaaccggcccgucauccagaucgacccgguggcgaugacccacaccucgcaguacaucugcucccccgugcugaccgauaacccccgccccaacgacccgaacgucgggaagugcaacgaccccuaccccggcaacaacaacaacggggugaagggcuucucguaccucgacggcgugaacaccuggcuggggcggaccaucuccaccgccucgcgcuccggcuacgagaugcugaagguccccaacgcccucaccgacgaccggucgaagccgauccaggggcagacgaucgugcugaauaccgacugguccggcuacucgggguccuucauggacuacugggccgagggcgacugcuaccgcgccugcuucuacguggagcugauccgcggccggcccaaggaggacaaggucugguggaccucgaacuccaucgugucgaugugcucguccaccgaguuccucgggcaguggaacuggcccgacggcgcgaagaucgaguacuuccuguga

SEQ ID NO: 26104 - RNA, 1413 nt, Artificial Sequence
  derived and/or modified CDS sequence (AUadapt) from InfluenzaA__AGQ81957__NA
augaaucccaaccagaagauccugugcaccucggccaccgccaucgugaucggcacgaucgcgguccucaucgggaucgccaaccugggccugaacaucgggcuccaccugaagccguccugcaacugcucgcacucccagcccgaggccaccaacaccucgcagaucaucaucaacaacuacuacaacgagaccaacaucacccagguguccaacaccaacauccagauggaggagcgcgccucgcggggcuucaacaaccugaccaaggggcucugcaccaucaacuccuggcauaucuacggcaaggacaacgccgugcgcaucggcgagaacucggacguccuggugacgcgggagcccuacguguccugcgaccccgacgagugccgcuucuacgcgcugucgcaggggaccaccauccggggcaagcacuccaacgggaccauccacgaccgcucgcaguaccgggcccucaucuccuggccgcugucguccccgcccacggucuacaacucgcgcguggagugcaucggcugguccucgaccuccugccacgauggcaagucgcggaugucgaucugcaucuccgggcccaacaacaacgccucggccguggucugguacaaccgccggcccguggcggagaucaacaccugggcccgcaacauccugcggacccaggaguccgagugcgugugccacaacggcgucugccccgugguguucacggacgggucggccaccggccccgccgacacccgcaucuacuacuucaaggaggggaagauccucaagugggagucccugaccggcacggccaagcacaucgaggagugcucgugcuacggcgagcggaccgggaucacguguacgugccgcgacaacuggcagggcuccaaccggcccgucauccagaucgacccgguggcgaugacccacaccucgcaguacaucugcucccccgugcugaccgacaacccccgccccaacgacccgaacgucgggaagugcaacgaccccuaccccggcaacaacaacaacggggugaagggcuucucguaccucgacggcgugaacaccuggcuggggcggacgaucuccaccgccucgcgcuccggcuaugagaugcugaagguccccaacgcccucaccgacgaccggucgaagccggugcaggggcagaccaucgugcugaacacggacugguccggcuacucgggguccuucauggacuacugggccgagggcgacugcuaccgcgccugcuucuacgucgagcugauccgcggccggcccaaggaggacaaggugugguggaccucgaacuccaucgucucgaugugcucguccaccgaguuccucgggcaguggaacuggcccgacggcgcgaagaucgaguacuuccuguga

SEQ ID NO: 26105 - RNA, 1413 nt, Artificial Sequence; identical to SEQ ID NO: 26087
  derived and/or modified CDS sequence (AUadapt) from InfluenzaA__AGQ81958__NA

SEQ ID NO: 26106 - RNA, 1413 nt, Artificial Sequence; identical to SEQ ID NO: 26087
  derived and/or modified CDS sequence (AUadapt) from InfluenzaA__AGQ81959__NA

SEQ ID NO: 26107 - RNA, 1413 nt, Artificial Sequence
  derived and/or modified CDS sequence (AUadapt) from InfluenzaA__AGQ81960__NA
augaaucccaaccagaagauccugugcaccucggccaccgccaucgugaucggcacgaucgcgguccucaucgggaucgccaaccugggccugaacaucgggcuccaccugaagccgaacugcaacugcucccgcucgcagcccgagaccaccaacaccucccagacgaucaucaacaacuacuacaacgagaccaacaucacccagaucucgaauaccaacauccagauggaggagcgggccucccgcgacuucaacaaccugacgaagggccucugcaccaucaacucguggcacaucuacgggaaggacaacgccgugcggaucggcgagaacuccgacgugcuggucacccgcgagcccuacgugucgugcgaccccaacgagugccgguuuuacgcccugucccagggcaccacgauccgcgggaagcacucgaacggcaccauccacgaccggucccaguaccgcgcgcucaucucguggccgcuguccucgccgcccaccguguacaacucccgggucgagugcaucggguggucguccaccucgugccacgacggcaagucccgcaugucgaucugcaucucggggcccaauaacaacgccuccgccguggugugguacaaccggcgccccgucgccgagaucaacacgugggcgcggaacauccugcgcacccaggagucggagugcgugugccacaacggcgugugccccgucguguucaccgacggcuccgccaccgggcccgccgacacgcggaucuacuacuucaaggagggcaagauccucaagugggagucgcugaccgggaccgccaagcauaucgaggagugcuccugcuacggcgagcgcaccgagaucacgugcacgugccgggacaacuggcagggcucgaaccgccccgugauccagaucgacccggucgccaugacccacaccucccaguacaucugcucgcccgugcugaccgacaacccccggcccaacgacccgaacguggggaagugcaaugaccccuaccccggcaacaacaacaacggggucaagggcuucuccuaccucgacggggugaacaccuggcugggccgcaccaucucgaccgcgucccggucgggcuacgagaugcugaaggugcccaacgcccucacggacgaccgcuccaagccgauccaggggcagaccaucguccugaacaccgacuggucgggcuacuccgggaguuucauggacuacugggccgagggcgacugcuaccgcgccugcuucuacguggagcugauccgggggcgccccaaggaggacaaggugugguggaccuccaacucgaucgucuccaugugcucgucgacggaguuccucggccagugggacuggcccgacggcgccaagaucgaguacuuccuguga

SEQ ID NO: 26108 - RNA, 1413 nt, Artificial Sequence; identical to SEQ ID NO: 26100
  derived and/or modified CDS sequence (AUadapt) from InfluenzaA__AGQ81961__NA

SEQ ID NO: 26109 - RNA, 1413 nt, Artificial Sequence; identical to SEQ ID NO: 26100
  derived and/or modified CDS sequence (AUadapt) from InfluenzaA__AGQ81962__NA

SEQ ID NO: 26110 - RNA, 1413 nt, Artificial Sequence
  derived and/or modified CDS sequence (AUadapt) from InfluenzaA__AGQ81963__NA
augaaucccaaccagaagauccugugcaccucggccaccgccaucgugaucggcacgaucgcgguccucaucgggaucgccaaccugggccugaacaucgggcuccaccugaagccguccugcaacugcucgcacucccagcccgaggagaccaacaccucgcagaccaucaucaacaacuacuacaacgagacgaacaucacccagaucuccaacaccaacauccagauggaggagcgcgccucgcggggcuucaauaaccugaccaaggggcucugcacgaucaacuccuggcacaucuacggcaaggacaacgccgugcgcaucggcgagaacucggacgugcuggucacccgggagcccuacguguccugcgaccccaacgagugccgcuucuacgcccugucgcaggggaccaccauccggggcaagcacuccaacgggacgauccacgaccgcucgcaguaucgggcgcucaucuccuggccgcugucguccccgcccaccguguacaacucgcgcgucgagugcaucggcugguccucgaccuccugccacgacggcaagucgcggaugucggugugcaucuccgggcccaacgacaacgccucggccguggucugguacaaccgccggcccguggccgagaucaacaccugggcgcgcaacauccugcggacgcaggaguccgagugcgugugccacaauggcgucugccccgugguguucaccgacgggucggccaccggccccgcccacacccgcaucuacuacuucaaggaggggaagauccucaagugggagucccugacgggcaccgccaagcacaucgaggagugcucgugcuacggcgagcggaccgggaucacgugcacgugccgcgacaacuggcagggcuccaaccggcccgucauccagaucgacccgguggccaugacccacaccucgcaguacaucugcucccccgugcugaccgauaacccccgccccaacgacccgaacgucgggaagugcaacgaccccuaccccggcaacaacaacaacggggugaagggcuucucguaccucgacggcgugaacaccuggcuggggcggaccaucuccaccgcgucgcgcuccggcuacgagaugcugaagguccccaacgcccucaccgacgaccggucgaagccgauccaggggcagacgaucgugcugaauaccgacugguccggcuacucgggguccuucauggacuacuggaccgagggcgacugcuaccgcgccugcuucuacguggagcugauccgcggccggcccaaggaggacaaggucugguggaccucgaacuccaucgugucgaugugcucguccacggaguuccucgggcagugggacuggcccgacggcgccaagaucgaguacuuccuguga

SEQ ID NO: 26111 - RNA, 1413 nt, Artificial Sequence
  derived and/or modified CDS sequence (AUadapt) from InfluenzaA__AGQ81964__NA
augaaucccaaccagaagauccugugcaccucggccaccgccaucgugaucggcacgaucgcgguccucaucgggaucgccaaccugggccugaacaucgggcuccaccugaagccguccugcaacugcucgcacuccaagcccgaggagaccaacgccucgcagaccaucaucaacaacuacuacaacgagaccaacaucacgcagaucuccaacaccaacauccagauggaggagcgcgccucgcggggcuucaauaaccugaccaaggggcucugcaccaucaacuccuggcacaucuacggcaaggacaacgccgugcgcaucggcgagucguccgacgugcuggucacgcgggagcccuacgugucgugcgaccccgacgagugccgcuucuacgcgcugucccaggggaccaccauccggggcaagcacucgaacgggaccauccacgaccgcucccaguaccgggcccucaucaguuggccgcuguccucgccgcccacgguguacaacucccgcgucgagugcaucggcuggucguccaccucgugccacgacggcaagucgcggauguccaucugcaucucggggcccaacaacaacgccuccgccguggugugguacaaccgccggcccgucgcggagaucaacaccugggcccgcaacauccugcggacccaggagucggagugcgugugccacaauggcgugugccccgucguguucacggacggguccgccaccggccccgccgacacccgcaucuacuacuucaaggaggggaagauccucaagugggagucgcugaccggcacggccaagcacaucgaggagugcuccugcuacggcgagcggaccgggaucacgugcacgugccgcgacaacuggcagggcucgaaccggcccgugauccagaucgacccggucgcgaugacccacaccucccaguacaucugcucgcccgugcugaccgauaacccccgccccaacgacccgaacguggggaagugcaacgaccccuaccccggcaacaacaacaacggggucaagggcuucuccuaccucgacggcgugaacaccuggcuggggcggaccaccucgaccaccucccgcucgggcuacgagaugcugaaggugcccaacgcccucacggacgaccgguccaagccgauccaggggcagaccaucguccugaacaccgauuggucgggcuacuccgggucguucauggacuacugggccgagggcgacugcuaccgcgccugcuucuacguggagcugauccgcggccggcccaaggaggacaaggugugguggaccuccaacucgaucgucucgaugugcuccucgacggaguuccucgggcaguggaacuggcccgacggcgccaagaucgaguacuuccuguga

SEQ ID NO: 26112 - RNA, 1413 nt, Artificial Sequence
  derived and/or modified CDS sequence (AUadapt) from InfluenzaA__AGQ81966__NA
augaaucccaaccagcgcauccugugcaccucggccaccgccaucgugaucggcacgaucgcgguccucaucgggguggccaaccugggccugaacaucgggcuccaccugaagccgggcugcaacugcucccacucgcagcccgaggccaccaacaccucccagaccaucaucaacaacuacuacaacgagacgaauaucacccagaucucgaacaccaacauccagauggaggagcgggccaaccgcggguucaacaaccugaccaagggccucugcacgaucaacuccuggcacaucuacggcaaggacaacgccgugcggaucggggagaacucggacguccuggugacccgcgagcccuacguguccugugaccccgacgagugccgguucuacgcgcugucgcagggcaccaccauccgcgggaagcacuccaacggcacgauccacgaccggucgcaguaccgcgcccucaucuccuggccgcugucguccccgcccaccgucuacaacucgcggguggagugcaucgggugguccaguaccuccugccacgacggcaagucgcgcauguccaucugcaucucgggccccaacaacaacgccucggccguggucugguacaaccggcgccccguggcggagaucaacaccugggcccggaacauccugcgcacgcaggaguccgagugcgugugccacaauggggucugccccgugguguucaccgacggcucggccaccgggcccgccgacacccgggucuacuacuuccgcgagggcaagauccucaagugggagucccugacgggcaccgccaagcacaucgaggagugcucgugcuacggggagcggaccggcaucacgugcacgugccgcgacaacuggcagggguccaaucggcccgugauccagaucgacccgguggcgaugacccacaccucgcaguacaucugcucccccguccugaccgacaacccccgccccaacgacccgaacgugggcaagugcaacgaccccuaccccgggaacaacaacaauggcgugaagggcuucucguaccucgacggggucaacaccuggcugggccggaccaucuccaccgccucgcgcuccggguacgagaugcugaaggugcccaacgcccucaccgacgaccgcucgaagccgauccagggccagacgaucgugcugaacaccgacugguccggguacucgggcuccuucauggacuauugggccgagggcgacugcuaccgggccugcuucuacgucgagcugauccgcgggcggcccaaggaggacaaggugugguggaccucgaacuccaucgucucgaugugcuccucgaccgaguuccucggccaguggaacuggcccgacggggcgaagaucgaguacuuccuguga

SEQ ID NO: 26113 - RNA, 1413 nt, Artificial Sequence
  derived and/or modified CDS sequence (AUadapt) from InfluenzaA__AGQ81967__NA
augaaucccaaccagaagauccugugcaccucggccaccgccaucgugaucggcaucaucgcgguccucaucgggaucgccaaccugggccugaacaucgggcuccaccugaagccguccugcaacugcucgcacucccagcccgaggccacgaacgccucgcagaccaucaucaacaacuacuacaacgagaccaacaucacccagaucuccaacacgaacauccagauggaggagcgcgccucgcggggcuucaacaaccugaccaaggggcucugcaccaucaacuccuggcacaucuacggcaaggacaacgcggugcgcaucggcgagaacucggacgugcuggucacccgggagcccuauguguccugcgaccccgacgagugccgcuucuacgcccugucgcaggggacgaccauccggggcaagcacuccaacgggaccauccacgaccgcucgcaguaccgggcccucaucuccuggccgcugucguccccgcccaccguguacaacucgcgcgucgagugcaucggcugguccucgacguccugccacgacggcaagucgcggaugucgaucugcaucuccgggcccaacaacaacgccucggcgguggugugguacaaccgccggcccgucgccgagaucaacaccugggcccgcaacauccugcggacccaggaguccgagugcgugugccauaacggcgugugccccgucguguucaccgacgggucggccacgggccccgccgagacccgcaucuacuacuucaaggaggggaagauccucaagugggagucccugaccggcaccgcgaagcacaucgaggagugcucgugcuacggcgagcggacggggaucacgugcacgugccgcgacaacuggcagggcuccaaccggcccgugauccagaucgacccggucgccaugacccacaccucgcaguacaucugcucccccgugcugaccgacaacccccgccccaacgacccgaacguggggaagugcaacgaccccuaccccggcaacaacaacaauggggucaagggcuucucguaccucgacggcgugaacaccuggcuggggcggaccaucuccaccgccucgcgcuccggcuacgagaugcugaaggugcccaacgcccucaccgacgaccggucgaagccgauccaggggcagaucaucguccugaacaccgacugguccggcuacucgggguccuucauggacuacugggccgagggcgacugcuaccgcgcgugcuucuacguggagcugauccgcggccggcccaaggaggacaaggugugguggaccucgaacuccaucgucucgaugugcucguccacggaguuccucgggcaguggaacuggcccgacggcgccaagaucgaguacuuccuguga

SEQ ID NO: 26114 - RNA, 1413 nt, Artificial Sequence
  derived and/or modified CDS sequence (AUadapt) from InfluenzaA__AGQ81968__NA
augaaucccaaccagaagauccugugcaccucggccaccgccaucgugaucggcaucaucgcgguccucaucgggaucgccaaccugggccugaacaucgggcuccaccugaagccguccugcaacugcucgcacucccagcccgaggccacgaacgccucgcagaccaucaucaacaacuacuacaacgagaccaacaucacccagaucuccaacacgaacauccagauggaggagcgcgccucgcggggcuucaacaaccugaccaaggggcucugcaccaucaacuccuggcacaucuacggcaaggacaacgcggugcgcaucggcgagaacucggacauccuggugacccgggagcccuacgucuccugugaccccgacgagugccgcuucuacgcccugucgcaggggacgaccauccggggcaagcacuccaacgggaccauccacgaccgcucgcaguaccggucccucaucucguggccgcuguccucgccgcccaccguguacaacucccgcguggagugcaucggcuggucguccacgucgugccacgacggcaagucgcggauguccaucugcaucucggggcccaacaacaacgccuccgccgucgugugguacaaccgccggcccguggcggagaucaacaccugggcccgcaacauccugcggacccaggagucggagugcgucugccauaacggcgugugccccguggucuucaccgacggguccgccacgggccccgccgagacccgcaucuacuacuucaaggaggggaagauccucaagugggagucgcugaccggcaccgccaagcacaucgaggagugcuccugcuacggcgagcggacggggaucacgugcacgugccgcgacaacuggcagggcucgaaccggcccgugauccagaucgacccgguggcgaugacccacaccucccaguacaucugcucgcccguccugaccgacaacccccgccccaacgacccgaacguggggaagugcaacgaccccuaccccggcaacaacaacaauggggugaagggcuucuccuaccucgacggcgucaacaccuggcuggggcggaccaucucgaccgccucccgcucgggcuacgagaugcugaaggugcccaacgcccucaccgacgaccgguccaagccgauccaggggcagaccaucgugcugaacaccgacuggucgggcuacuccgggucguucaucgacuacugggccgagggcgacugcuaccgcgccugcuucuacgucgagcugauccgcggccggcccaaggaggacaaggugugguggacguccaacucgaucgugucgaugugcuccucgaccgaguuccucgggcaguggaacuggcccgacggcgcgaagaucgaguacuuccuguga

SEQ ID NO: 26115 - RNA, 1413 nt, Artificial Sequence
  derived and/or modified CDS sequence (AUadapt) from InfluenzaA__AGQ81969__NA
augaaucccaaccagaagauccugugcaccucggccaccgccaucgugaucggcaucaucgcgguccucaucgggaucgccaaccugggccugaacaucgggcuccaccugaagccguccugcaacugcucgcacucccagcccgaggagacgaacgccucgcagaccaucaucaacaacuacuacaacgagaccaacaucacccagaucuccaacacgaacauccagauggaggagcgcgccucgcggggcuucaacaaccugaccaaggggcucugcaccaucaacuccuggcacaucuacggcaaggacaacgccgugcgcaucggcgagaacucggacgugcuggucacccgggagcccuauguguccugcgaccccgacgagugccgcuucuacgcgcugucgcaggggacgaccauccggggcaagcacuccaacgggaccauccacgaccgcucgcaguaccgggcccucaucuccuggccgcugucguccccgcccaccguguacaacucgcgcgucgagugcaucggcugguccucgacguccugccacgacggcaagucgcggaugucgaucugcaucuccgggcccaacaacaacgccucggccguggugugguacaaccgccggcccgucgcggagaucaacaccugggcccgcaacauccugcggacccaggaguccgagugcgugugccauaacggcgugugccccgucguguucaccgacgggucggccacgggccccgccgagacccgcaucuacuacuucaaggaggggaagauccucaagugggagucccugaccggcaccgccaagcacaucgaggagugcucgugcuacggcgagcggacggggaucacgugcacgugccgcgacaacuggcagggcuccaaccggcccgugauccagaucgacccggucgcgaugacccacaccucgcaguacaucugcucccccgugcugaccgacaacccccgccccaacgacccgaacguggggaagugcaacgaccccuaccccggcaacaacaacaauggggucaagggcuucucguaccucgacggcgugaacaccuggcuggggcggaccaucuccaccgccucgcgcuccggcuacgagaugcugaaggugcccaacgcccucaccgacgaccggucgaagccgauccaggggcagaucaucguccugaacaccgacugguccggcuacucgggguccuucauggacuacugggccgagggcgacugcuaccgcgccugcuucuacguggagcugauccgcggccggcccaaggaggacaaggugugguggaccucgaacuccaucgucucgaugugcucguccacggaguuccucgggcaguggaacuggcccgacggcgcgaagaucgaguacuuccuguga

SEQ ID NO: 26116 - RNA, 1413 nt, Artificial Sequence
  derived and/or modified CDS sequence (AUadapt) from InfluenzaA__AGQ81970__NA
augaaucccaaccagaagauccugugcaccucggccaccgccaucgugaucggcacgaucgcgguccucaucgggaucgccaaccugggccugaacaucgggcuccaccugaagccguccugcaacugcucgcacucccagcccgaggagaccaacgccucgcagaccaucaucaacaacuacuacaacgagaccaacaucacgcagaucuccaacaccaacauccagauggaggagcgcgccucgcggggcuuuaacaaccugaccaaggggcucugcaccaucaacuccuggcacaucuacggcaaggacaacgccgugcgcaucggcgagaacucggacgugcuggucacgcgggagcccuacguguccugcgaccccgacgagugccgcuucuacgcgcugucgcaggggaccaccauccggggcaagcacuccaacgggaccauccacgaccgcagucaguaccgggcccucaucuccuggccgcugucguccccgcccacgguguacaacucgcgcgucgagugcaucggcugguccucgaccuccugccacgacggcaagucgcggaugucgaucugcaucuccgggcccaacaacaacgccucggccguggugugguacaacaagcgccccgucgcggagaucaacaccugggcccggaacauccugcgcacccaggaguccgagugcgugugccauaacggcgugugccccgucguguucacggacgggucggccaccggccccgccgacacccggaucuacuacuucaaggaggggaagauccucaagugggagccccugaccggcacggccaagcacaucgaggagugcuccugcuacggcgagcgcaccgggaucacgugcacgugccgggacaacuggcagggcucgaaccgcccggugauccagaucgaccccgucgcgaugacccacaccucccaguacaucugcagucccgugcugaccgacaacccccggccgaacgaccccaacguggggaagugcaacgaccccuaccccggcaacuccaacaacggggucaagggcuucucguaccucgacggcgugaacaccuggcuggggcgcaccaucuccaccgccucgcgguccggcuacgagaugcugaaggugccgaacgcccucaccgacgaccgcucgaagcccauccaggggcagaccaucguccugaauacggacugguccggcuacucgggguccuucauggacuacugggccgagggcgacugcuaccgggccugcuucuacguggagcugauccgcggccgccccaaggaggacaaggugugguggaccucgaacuccaucgucucgaugugcucguccaccgaguuccucgggcaguggaacuggcccgacggcgcgaagaucgaguacuuccuguga

SEQ ID NO: 26117 - RNA, 1413 nt, Artificial Sequence
  derived and/or modified CDS sequence (AUadapt) from InfluenzaA__AGQ81971__NA
augaaucccaaccagaagauccugugcaccucggccaccgccaucaucaucggcgcgaucgccgugcucaucgggaucgccaaccugggccugaacaucgggcuccaccugaagccguccugcaacugcucgcacucccagcccgagacgaccaacaccucgcagaccaucaucaacaacuacuacaacgagacgaacaucacccagaucuccaacaccaacauccagauggaggagcgcaccucgcggggcuucaacaaccugacgaaggggcucugcaccaucaacuccuggcauaucuacggcaaggacaacgccguccgcaucggcgagucguccgacgugcuggugacccgggagcccuacgucucgugcgaccccgacgagugccgcuucuacgcccugucccaggggaccacgauccggggcaagcacucgaacgggaccauccacgaccgcucccaguaccgggcgcucaucucguggccgcuguccucgccgcccaccguguacuccucgcgcguggagugcaucggcugguccucgaccucgugccacgaugggaagucccggaugucgaucugcaucuccggccccaacaacaacgccucggccgucgugugguacaaccgccggcccguggccgagaucaacacgugggcgcgcaacauccugcggacccaggaguccgagugcgucugccacaacggcgugugccccguggucuucaccgacgggucggccaccggccccgccgacacgcgcaucuacuacuucaaggaggggaagauccucaagugggagucccugaccggcaccgccaagcacaucgaggagugcucgugcuacggcgagcggaccgggaucacguguacgugccgcgacaacuggcagggcuccaaccggcccgugauccagaucgacccgguggccaugacccacaccucgcaguacaucugcucccccguccugaccgacaacccccgccccaacgacccgaacaucgggaagugcaacgaccccuaccccggcaacaacaacaacggggugaagggcuucucguaccucgacggcgcgaacaccuggcuggggcggaccaucuccaccgccucgcgcuccggcuaugagaugcugaaggugcccaacgcccucacggacgaccggucgaagccgauccaggggcagaccaucguccugaacaccgacugguccggcuacucgggguccuucauggacuacugggccgagggcgacugcuaccgcgccugcuucuacguggagcugauccgcggccggcccaaggaggacaaggugugguggaccucgaacucgaucgucuccaugugcucguccacggaguuccucgggcaguggaacuggcccgacggcgcgaagaucgaguacuuccuguga

SEQ ID NO: 26118 - RNA, 1413 nt, Artificial Sequence
  derived and/or modified CDS sequence (AUadapt) from InfluenzaA__AGQ81972__NA
augaaucccaaccagaagauccugugcaccucggccaccgccaucaucaucggcgcgaucgccgugcucaucgggaucgccaaccugggccugaacaucgggcuccaccugaagccguccugcaacugcucgcacucccagcccgagacgaccaacaccucgcagaccaucaucaacaacuacuacaacgagacgaacaucacccagaucuccaacaccaacauccagauggaggagcgcgccucgcggggcuucaauaaccugaccaaggggcucugcacgaucaacuccuggcacaucuacggcaaggacaacgccguccgcaucggcgagucguccgacgugcuggugacccgggagcccuacgucucgugcgaccccgacgagugccgcuucuacgcgcugucccaggggaccaccauccggggcaagcacucgaacgggacgauccacgaccgcucccaguaccgggcccucaucaguuggccgcuguccucgccgcccaccguguacaacucccgcguggagugcaucggcuggucguccaccucgugccacgacggcaagucgcggauguccaucugcaucucggggcccaacaacaacgccuccgccgucgugugguacaaccgccggcccguggcggagaucaacaccugggcccgcaacauccugcggacgcaggagucggagugcgucugccacaauggcgugugccccguggucuucaccgacggguccgccaccggccccgccgacacccgcaucuacuacuucaaggaggggaagauccucaagugggagucgcugacgggcaccgccaagcacaucgaggagugcuccugcuacggcgagcggaccgggaucacgugcacgugccgcgacaacuggcagggcucgaaccggcccgugauccagaucgacccgguggcgaugacccacaccucccaguacaucugcucgcccguccugaccgauaacccccgccccaacgacccgaacaucgggaagugcaacgaccccuaccccggcaacaacaacaacggggugaagggcuucuccuaccucgacggcgccaacaccuggcuggggcggaccaucucgaccgccucccgcucgggcuacgagaugcugaaggugcccaacgcccucaccgacgaccgguccaagccgauccaggggcagacgaucguccugaacaccgauuggucgggcuacuccgggucguucauggacuacugggccgagggcgacugcuaccgcgcgugcuucuacguggagcugauccgcggccggcccaaggaggacaaggugugguggaccuccaacucgaucgucucgaugugcuccucgaccgaguuccucgggcaguggaacuggcccgacggcgccaagaucgaguacuuccuguga

SEQ ID NO: 26119 - RNA, 1413 nt, Artificial Sequence
  derived and/or modified CDS sequence (AUadapt) from InfluenzaA__AGQ81973__NA
augaaucccaaccagaagauccugugcaccucggccaccgccaucaucaucggcgcgaucgccgugcucaucgggaucgccaaccugggccugaacaucgggcuccaccugaagccguccugcaacugcucgcacucccagcccgagacgaccaacaccucgcagaccaucaucaacaacuacuacaacgagacgaacaucacccagaucuccaacaccaacauccagauggaggagcgcaccucgcggggcuucaauaaccugacgaaggggcucugcaccaucaacuccuggcacaucuacggcaaggacaacgccguccgcaucggcgagucguccgacgugcuggugacccgggagcccuacgucucgugcgaccccgacgagugccgcuucuacgcccugucccaggggaccacgauccggggcaagcacucgaacgggaccauccacgaccgcucccaguaccgggcgcucaucaguuggccgcuguccucgccgcccaccguguacaacucccgcguggagugcaucggcuggucguccaccucgugccacgacggcaagucgcggauguccaucugcaucucggggcccaacaacaacgccuccgccgucgugugguacaaccgccggcccguggccgagaucaacacgugggcgcgcaacauccugcggacccaggagucggagugcgucugccacaauggcgugugccccguggucuucaccgacggguccgccaccggccccgccgacacgcgcaucuacuacuucaaggaggggaagauccucaagugggagucgcugaccggcaccgccaagcacaucgaggagugcuccugcuacggcgagcggaccgggaucacgugcacgugccgcgacaacuggcagggcucgaaccggcccgugauccagaucgacccgguggccaugacccacaccucccaguacaucugcucgcccguccugaccgauaacccccgccccaacgacccgaacaucgggaagugcaacgaccccuaccccggcaacaacaacaacggggugaagggcuucuccuaccucgacggcgcgaacaccuggcuggggcggaccaucucgaccgccucccgcucgggcuacgagaugcugaaggugcccaacgcccucacggacgaccgguccaagccgauccaggggcagaccaucguccugaacaccgauuggucgggcuacuccgggucguucauggacuacugggccgagggcgacugcuaccgcgccugcuucuacguggagcugauccgcggccggcccaaggaggacaaggugugguggaccuccaacucgaucgucucgaugugcuccucgacggaguuccucgggcaguggaacuggcccgacggcgcgaagaucgaguacuuccuguga

SEQ ID NO: 26120 - RNA, 1413 nt, Artificial Sequence; identical to SEQ ID NO: 26100
  derived and/or modified CDS sequence (AUadapt) from InfluenzaA__AGQ81974__NA

SEQ ID NO: 26121 - RNA, 1398 nt, Artificial Sequence
  derived and/or modified CDS sequence (AUadapt) from InfluenzaA__AGQ81975__NA
augaaucccaaccagaagauccugugcaccucggccaccgccaucaucaucggcgcgaucgccgugcucaucgggaucgccaaccugggccugaacaucgggcuccaccugaagccgggcugcaacugcucccacucgcagcccgagacgaccaacaccucccagaccaucaucaacaacuacuauaacgagacgaacaucaccaacauccagauggaggagcgcaccucgcggaacuucaacaaccugaccaaguggcucugcacgaucaacuccuggcacaucuacgggaaggacaacgccguccgcaucggcgagaacagugacgugcuggugacccgggagcccuacgucuccugcgaccccgacgagugccgcuucuacgcccugucgcagggcaccaccauccgggggaagcacuccaacggcacgauccacgaccgcucgcaguaccgggcgcucaucuccuggccgcugaguuccccgcccaccguguacaacucgcgcguggagugcaucgggugguccucgaccuccugccacgacggcaagucgcggauguccaucugcaucucggggcccaacaacaacgccucggccgucgugugguauaaccgccggcccguggccgagaucaacaccugggcgcgcaacauccugcggacgcaggaguccgagugcgucugccacaacggcgugugccccguggucuucaccgacggcucggccaccgggcccgccgacacccgcaucuacuacuucaaggagggcaagauccucaagugggagucccugacggggaccgccaagcauaucgaggagugcucgugcuacggcgagcggaccggcaucacgugcacgugccgcgacaacuggcagggguccaaccggcccgugauccagaucgacccgguggccaugacccacaccucgcaguacaucugcucccccguccugaccgacaauccccgccccgacgacccgaacaucggcaagugcaacgaccccuaccccgggaacaacaacaacggcgugaagggguucucguaccucgacggcgcgaauaccuggcugggccggaccaucuccaccgccucgcgcuccggguacgagaugcugaaggugcccaacgcccucaccgacgaccggucgaagccgauccagggccagacgaucguccugaacgccgacugguccggguacucgggcuccuucauggacuacugggccgacggggacuguuaccgcgcgugcuucuacguggagcugauccgcggccggcccaaggaggacaaggugugguggaccucgaacuccaucgucucgaugugcuccucgaccgaguuccucggccaguggaacuggcccgacggggccaagaucgaguacuuccuguga

SEQ ID NO: 26122 - RNA, 1398 nt, Artificial Sequence
  derived and/or modified CDS sequence (AUadapt) from InfluenzaA__AGQ81977__NA
augaaucccaaccagaagauccugugcaccucggccaccgccaucaucaucggcgcgaucgccgugcucaucgggaucgccaaccugggccugaacaucgggcuccaccugaagccgggcugcaacugcucccacucgcagcccgagacgaccaacaccucccagaccaucaucaacaacuacuauaacgagacgaacaucaccaacauccagauggaggagcgcaccucgcggaacuucaacaaccugaccaaggggcucugcacgaucaacuccuggcacaucuacggcaaggacaacgccguccgcaucggcgagucguccgaugugcuggugacccgggagcccuacgucucgugcgaccccgacgagugccgcuucuacgcccugucccaggggaccaccauccggggcaagcacucgaacgggacgauccacgaccgcucccaguaccgggcgcucaucucguggccgcuguccaguccgcccaccguguacaacucccgcguggagugcaucggcuggucguccaccucgugccacgacgggaagucccggaugucgaucugcaucucgggccccaacaacaacgccuccgccgucgugugguacaaucgccggcccguggccgagaucaacaccugggcgcgcaacauccugcggacgcaggagucggagugcgucugccacaacggcgugugccccguggucuucaccgacggguccgccaccggccccgccgacacccgcaucuacuacuucaaggaggggaagauccucaagugggagucgcugacgggcaccgccaagcauaucgaggagugcuccugcuacggcgagcggaccgggaucacgugcacgugccgcgacaacuggcagggcucgaaccggcccgugauccagaucgacccgguggccaugacccacaccucccaguacaucugcucgcccguccugaccgacaauccccgccccgacgacccgaacaucgggaagugcaacgaccccuaccccggcaacaacaacaacggggugaagggcuucuccuaccucgacggcgcgaacaccuggcuggggcggaccaucaguaccgccucccgcucgggcuacgagaugcugaaggugcccaacgcccucaccgacgaccgguccaagccgauccaggggcagacgaucguccugaacgccgacuggucgggcuacuccgggucguucauggacuacugggccgacggcgacuguuaccgcgcgugcuucuacguggagcugauccgcggccggcccaaggaggacaaggugugguggaccuccaacucgaucgucuccaugugcucgucgaccgaguuccucgggcaguggaacuggcccgacggcgccaagaucgaguacuuccuguga

SEQ ID NO: 26123 - RNA, 1398 nt, Artificial Sequence
  derived and/or modified CDS sequence (AUadapt) from InfluenzaA__AGQ81979__NA
augaaucccaaccagaagauccugugcaccucggccaccgccaucaucaucggcgcgaucgccgcccucaucgggaucgccaaccugggccugaacaucgggcuccaccugaagccgggcugcaacugcucccacucgcagcccgagacgaccaacaccucccagaccaucaucaacaauuacuacaacgagacgaacaucaccaacauccagauggaggagcgcaccucgcggaacuucaacaaccugaccaaggggcucugcacgaucaacuccuggcacaucuauggcaaggacaacgccgugcgcaucggcgagucguccgacguccuggugacccgggagcccuacgugucgugcgaccccgacgagugccgcuucuacgcgcugucccaggggaccaccauccggggcaagcacucgaaugggacgauccacgaccgcucccaguaccgggcccucaucucguggccgcuguccucgccgcccaccgucuacaacucccgcguggagugcaucggcuggucguccaccucgugccacgacgggaagucccggaugaguaucugcaucucgggccccaacaacaacgccuccgccguggucugguacaaccgccggcccguggcggagaucaacaccugggcccgcaacauccugcggacgcaggagucggagugcgugugccacaacggcgucugucccgugguguucaccgacggguccgccaccggccccgccgacacccgcaucuacuacuucaaggaggggaagauccucaagugggagucgcugacgggcaccgccaagcacaucgaggagugcuccugcuacggcgagcggaccgggaucacgugcacgugccgcgauaacuggcagggcucgaaccggcccgucauccagaucgacccgguggcgaugacccacaccucccaguacaucugcucgcccgugcugaccgacaacccccgccccgacgacccgaacaucgggaaguguaacgaccccuaccccggcaacaacaacaacggggucaagggcuucuccuaccucgacggcgccaacaccuggcuggggcggaccaucucgaccgccucccgcucgggcuacgagaugcugaaggugcccaaugcccucaccgacgaccgguccaagccgauccaggggcagacgaucgugcugaacgccgacuggucgggcuacuccgggucguucauggacuacugggcggacggcgacugcuaucgcgccugcuucuacgucgagcugauccgcggccggcccaaggaggacaaggugugguggaccuccaacucgaucguguccaugugcucgucgaccgaguuccucgggcaguggaacuggcccgacggcgccaagaucgaguacuuccuguga

SEQ ID NO: 26124 - RNA, 1398 nt, Artificial Sequence; identical to SEQ ID NO: 26122
  derived and/or modified CDS sequence (AUadapt) from InfluenzaA__AGQ81980__NA

SEQ ID NO: 26125 - RNA, 1350 nt, Artificial Sequence
  derived and/or modified CDS sequence (AUadapt) from InfluenzaA__AGQ88501__NA
augaaucccaaccagaagaucgugaccaucggcucgaucugcauggucaucgggaucgugucccugaugcuccagaucggcaacaugaucagcaucugggugucccacagcauccagaccgggaaccagcaucagacggagccgauccgcaacaccaacuuccugaccgagaacgccgucgccuccguggcgcugagcggcaacuccagccucugccccauccgggggugggccgugcauuccaaggacaacagcauccgcaucggcuccaagggcgacgucuucgugauccgggagcccuucaucagcugcuccaaucuggagugccgcaccuucuuccugacgcagggggcccuccugaacgacaagcacagcaacggcaccgugaaggaucggagcccccaccgcacccugauguccugcccgaucggggaggcccccucccccuacaacagccgguucgaguccgucgccuggagcgcgagugccugccacgacggcaucuccuggcucaccaucgggaucagcggccccgacaacggcgccguggccgugcugaaguacaacgggaucaucacggauaccaucaaguccuggcgcaacaacauccugcggacccaggagagcgagugcacgugcgucaacggcuccugcuucaccgugaugaccgaugggccgucgaacggccaggcguccuacaagaucuucaagaucgagaagggcaagguggucaagagcguggagcucaacgcccccaacuaccauuacgaggagugcuccugcuaccccgacgccggggagaucaucugcgugugccgcgacaauuggcacggcagcaaccggcccugggucuccuucaaccagaaccuggaguaccagaucggguacaucuguagcggcguguucggggacaacccgcgccccaacgacggcgagggcuccugcgggcccgugagccccaauggcgccuacggggucaagggcuucuccuucaaguacgggaacggcguguggaucggccggaccaagagcacccacucccgcagcggguuugagaugaucugggacccgaacggcuggacggggaccgacuccgaguucagcaugaagcaggacaucguggccaucaccgacuggagcggcuauuccgggagcuucguccagcaccccgagcugaccggccucgacugcauccggcccugcuucuggguggagcugauccgcggccggcccaaggaguccacgaucuggaccagcggguccaguaucuccuucugcggcgucaacagcgacaccguguccuggagcuggccggacggggcggagcugcccuucaccaucgacaaguga

SEQ ID NO: 26126 - RNA, 1401 nt, Artificial Sequence; identical to SEQ ID NO: 26004
  derived and/or modified CDS sequence (AUadapt) from InfluenzaA__AGR33906__NA

SEQ ID NO: 26127 - RNA, 1401 nt, Artificial Sequence
  derived and/or modified CDS sequence (AUadapt) from InfluenzaA__AGR33908__NA
augaaccccaaccagaagaucaccgccaucggcucggugucccugaucaucgccaucaucugccuccugaugcagaucgcgauccugaccacgaccaugacccuccacuuccgccagaacgagugcucgaacccguccaacaaccaggucaugcccugcgagcccaucaucaucgagcggaacaccgugcaccugaacucgacgaccaucgagcgcgagaucugccccaagguggccgaguacaagaacugguccaagccgcagugccagaucaccggguucgcccccuucucgaaggacaacuccauccggcugagcgccggcggggacaucugggucacccgcgagcccuacguguccugcucgcccgacaagugcuaccaguucgcccucggccaggggacgacccugaagaacaagcacuccaacggcaccacccacgaccggacgccgcaccgcacccugcucaugaacgagcugggcgugcccuuccaccuggggaccaagcaggucugcaucgcguggucguccucguccugcuacgacggcaaggccuggcuccacaucugcgugaccggggacgacaagaacgccacggccagcaucaucuacgacggcaugcugguggacuccaucgggucgugguccaagaacauccugcggacccaggagucggagugcgucugcaucaacgggaccugcgcgguggugaugaccgacggcucggccuccggcgaggccgacacgcgcauccucuucauccgggagggcaagaucaucaacaucagcccccuguccgggucggcccagcacgucgaggagugcuccugcuacccccgcuacccggaggugcggugcgugugccgcgacaacuggaagggcucgaaccggcccaucaucuacaucaacauggucgacuacuccaucgagucgcgcuacgugugcuccggccuggugggggacacgccccggaacgacgacagcaccuccucguccaacugccgcgaccccaacaacgagcggggcgccccgggggucaagggcugggcguucgacgacgggaacgacguguggaugggccgcaccaucaagaacggcucgcgguccggguacgagaccuuccgcgugaucaacggcuggaccauggccaacucgaagucccagaucaaccggcaggucaucguggacagcgacaacugguccggguacucgggcaucuucucgguggaggggaagaagugcaucaaccgcugcuucuacgucgagcucauccgcggccggccccaggagccccgcgugugguggaccuccaacucgaucaucgucuucugcggcaccuccgggacguacggcaccgggagcuggcccgacggcgccgacaucaacuucaugccgaucuga

SEQ ID NO: 26128 - RNA, 1401 nt, Artificial Sequence
  derived and/or modified CDS sequence (AUadapt) from InfluenzaA__AGR33910__NA
augaaccccaaccagaagaucaucgccaucggcucggugucccugaccaucgccaucaucugcuuccucaugcagaucgcgauccugaccacgaccaugacccugcacuucaagcagaacgagugcucgaagccguccaacaaccaggucgugcccugcgagcccauccucaucgagcgcaacaccgugcaccugaacucgacgaccaucgagaaggaggucugccccaagguggccgaguacaagaacugguccaagccgcagugccagaucaccggguucgcccccuucagcaaggacaacuccauccggcugucggccggcggggacaucugggugacccgcgagcccuacgucuccugcucguucggcaagugcuaccaguucgcccucgggcagggcacgacccugaagaacaagcacuccaacggcaccacccacgaccggacgccccaccgcacccugcucaugaacgagcugggggugccguuccaccugggcaccaagcaggucugcaucgcguggagcuccucguccugcuacgacgggaaggccuggcuccacaucugcgugaccggcgacgacaagaacgccacggccucgaucaucuacgacgggaugcugguggacuccaucggcagcugguccaagaacauccugcggacccaggagucggagugcgugugcaucaacgggaccugcgcggucgugaugaccgacgggucggccuccggcaaggccgacacgcgcauccucuucauccgggaggggaagaucaucaacauccgcccccugagcggcuccgcccagcacguggaggagugcucgugcuacccccgguaccccgagguccgcugcgugugccgggacaacuggaagggcuccaaccgcccggugcuguacaucaacauggccgacuacucggucgaguccagcuacgugugcuccgggcucgugggcgacacgccccggaacgacgacucguccucguccagcaacugccgcgaccccaacaacgagcggggcgcgcccggcgucaaggggugggccuucgacgacggcaacgacguguggaugggccgcaccauccggaacgacucccgcucgggguacgagaccuuccggguggucaacggcuggaccaccgccaacuccaagucgcagaucaaccgccaggugaucgucgacuccgagaacuggagcggguacucgggcaucuucuccguggaggggaagaacugcaucaaccggugcuucuacguggagcugauccgcggccgcccgcaggagccccgggucugguggaccucgaacuccaucaucguguucugcggcaccagcgggacguacggcaccggguccuggcccgacggcgccaacaucaacuucaugcccaucuga

SEQ ID NO: 26129 - RNA, 1401 nt, Artificial Sequence
  derived and/or modified CDS sequence (AUadapt) from InfluenzaA__AGR33911__NA
augaaccccaaccagaagaucaucgccaucggcucggugucccugaccaucgccaucaucugcuuccucaugcagaucgcgauccugaccacgaccaugacccugcacuucaagcagaacgagugcucgaacccguccaacaaccaggucgugcccugcgagcccauccucaucgagcgcaacaccgugcaccugaacucgacgaccaucgagaaggaggucugccccaagguggccgaguacaagaacugguccaagccgcagugccagaucaccggguucgcccccuucagcaaggacaacuccauccggcugucggccggcggggacaucugggugacccgcgagcccuacgucuccugcucgcucggcaagugcuaccaguucgcccuggggcagggcacgacccugaagaacaaccacuccaacggcaccacccacgaccggacgccccaccgcacccuccugaugaacgagcugggggugccguuccaccucggcaccaagcaggucugcaucgcguggagcuccucguccugcuacgacgggaaggccuggcugcacaucugcgugaccggcgacgacaagaacgccacggccucgaucaucuacgacgggaugcugguggacuccaucggcagcugguccaagaacauccuccggacccaggagucggagugcgugugcaucaacgggaccugcgcggucgugaugaccgacggcucggccuccggcaaggccgacacgcgcauccuguucauccgggaggggaagaucaucaacaucagcccccuguccggcucggcccagcacguggaggagugcuccugcuacccccgcuaccccgagguccggugcgugugccgcgacaacuggaagggcucgaaccggccggugcucuacaucaacauggccgacuacuccaucgagucguccuacgucugcagcgggcuggugggcgacacgccccgcaacgacgacuccucguccucguccaacugccgggaccccaacaacgagcgcggggcgcccggcgugaaggggugggccuucgacgacggcaacgacgucuggaugggccggaccauccgcaacaacagccgguccggguacgagaccuuccgcguggugaacggcuggaccaccgccaacucgaagucccagaucaaccggcaggucaucguggacucggagaacuggagcggguacuccggcaucuucucggucgaggggaagaacugcaucaaccgcugcuucuacguggagcugauccggggccgcccgcaggagccccgcgugugguggaccuccaacucgaucaucgucuucugcggcaccuccgggacguacggcaccgggagcuggcccgacggcgccaacaucaacuucaugcccaucuga

SEQ ID NO: 26130 - RNA, 1356 nt, Artificial Sequence; identical to SEQ ID NO: 26045
  derived and/or modified CDS sequence (AUadapt) from InfluenzaA__AGR33912__NA

SEQ ID NO: 26131 - RNA, 1356 nt, Artificial Sequence; identical to SEQ ID NO: 26075
  derived and/or modified CDS sequence (AUadapt) from InfluenzaA__AGR33913__NA

SEQ ID NO: 26132 - RNA, 1356 nt, Artificial Sequence; identical to SEQ ID NO: 26045
  derived and/or modified CDS sequence (AUadapt) from InfluenzaA__AGR33915__NA

SEQ ID NO: 26133 - RNA, 1356 nt, Artificial Sequence
  derived and/or modified CDS sequence (AUadapt) from InfluenzaA__AGR33916__NA
augaaucccaaccagaagcuguucgccucguccggcguggccaucgcgcucucgguccugaaucugcucaucgggcuguccaacgugggccugaacgugagccuccaccugaaggagaccgggccgaagcaggaggagaaccugaccuguaugacgaccaaggagaccgagcucggcacccccuccuaccugcugcucaacaagucgcugugcaaugucgagggguggguggugaucgccaaggacaacgccguccgcuucggcgaguccgagcagaucaucaucacgcgggagcccuacgugagcugugaccccaacggcugcaagauguacgcccugcaccaggggaccaccauccgcaauaagcacuccaacggcaccauccacgaccggacggccuuucgcgggcucaucucgaccccgcugggcaccccgcccaccguguccaacagcgacuucaucugugucgggugguccucgacgaccugccacgacggcaucggccggaugaccaucugcauccaggggaauaacgacaacgcgaccgccacgguguacuauaaccgccggcugaccaccaccaucaagacgugggcccgcaacauccuccggacccaggaguccgagugcgugugccacaaugggaccugcgccgucgugaugaccgacggcucggcguccagccaggcccacacgaaggugauguauuuccacaagggccuggucgugaaggaggaggcccugaagggcuccgccaagcacaucgaggagugcaguugcuacgggcacaaccagaaggugaccugcgucugucgcgacaacuggcagggcgccaaccggcccaucaucgagaucgacaugaacacccucgagcauaccagccgcuacgugugcacggggauccugaccgacaccucccggcccggcgauaagcccaccggggacugcucgaaccccaucacgggcucccccggcgcgccgggggugaagggcuucggguuucugaacggcgacaacaccuggcucgggcgcaccaucagcccccggucccgcucgggcuuugagaugcugaagauccccaacgccggcaucgaccccaacucccggaucgccgagcgccaggagaucgucgacaauucgaacugguccggguacagcggcuccuucaucgauuacuggaacgacaacucggaguguuacaacccgugcuucuauguggagcugauccgggggcgccccgaggaggccaaguacgugugguggaccuccaacagccucaucgcccugugcggcucccccuuccccgucgggaguggcuccuucccggacggcgcgcagauccaguacuucagcuga

SEQ ID NO: 26134 - RNA, 1356 nt, Artificial Sequence; identical to SEQ ID NO: 26075
  derived and/or modified CDS sequence (AUadapt) from InfluenzaA__AGR33917__NA

SEQ ID NO: 26135 - RNA, 1356 nt, Artificial Sequence; identical to SEQ ID NO: 26045
  derived and/or modified CDS sequence (AUadapt) from InfluenzaA__AGR33918__NA

SEQ ID NO: 26136 - RNA, 1398 nt, Artificial Sequence; identical to SEQ ID NO: 26122
  derived and/or modified CDS sequence (AUadapt) from InfluenzaA__AGR33919__NA

SEQ ID NO: 26137 - RNA, 1413 nt, Artificial Sequence
  derived and/or modified CDS sequence (AUadapt) from InfluenzaA__AGR45094__NA
augaaccccaaccagaagaucaucaccaucggcucgaucuccauggccaucgggaucaucucgcugauccuccagaucggcaacaucaucuccaucugggccagccacuccauccagaccgggucgcagaaccacacgggcaucugcaaccagcgcaucaucaccuacgagaacuccaccugggugaaccagaccuacgucaacaucaacaacacgaacgugguggcggggaaggacaagaccagcgucacccuggccggcaacuccucgcugugcccgauccggggcugggccaucuacaccaaggacaacuccauccgcaucgggucgaagggcgacguguucgugauccgggagcccuucaucuccugcagccaccucgagugccgcacguucuuccugacccagggggcccugcucaacgacaagcacuccaacggcaccgucaaggaccggucgcccuaccgcgcccugauguccugcccccugggggaggcgccgagccccuacaacucccgguucgagucgguggccuggagcgccuccgccugccacgacggcaugggcuggcucaccaucgggaucucgggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcccggccuccuaccgcaucuucaagaucgagaaggggaagaucaccaagucgaucgagcucgacgcccccaacuaccacuacgaggagugcuccugcuaccccgacaccggcaccgucaugugcgugugccgggacaacuggcacgggagcaaccgccccuggguguccuucaaccagaaccuggacuaccagaucggcuacaucugcucgggcgucuucggggacaacccgcggcccaaggacggcgagggguccugcaaccccgugacgguggacggcgccgacggggucaagggcuucagcuaccgcuacggcaacgggguguggaucggccggaccaaguccaacucgucccgcaagggguucgagaugaucugggaccccaacggcuggaccgacaccgacucggacuucuccgugaagcaggacgucgugccgaugacggacuggagcggguacucgggcuccuucgugcagcaccccgagcugaccggccucgacugcaugcggcccugcuucugggucgagcugauccgcgggcggccccgcgagaacaccaccaucuggacgagcggcuccucgaucuccuucugcggggugaacagcgacaccgcgaacugguccuggccggacgacgccgagcugccccucaccaucgacaaguga

SEQ ID NO: 26138 - RNA, 1413 nt, Artificial Sequence; identical to SEQ ID NO: 21332
  derived and/or modified CDS sequence (AUadapt) from InfluenzaA__AGR49780__NA

SEQ ID NO: 26139 - RNA, 1410 nt, Artificial Sequence
  derived and/or modified CDS sequence (AUadapt) from InfluenzaA__AGR49804__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcugaccgggaacucgucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggacgaucaaggaccggucccccuaccgcacccugaugucgugcccgaucggcgaggugcccucccccuacaacagccgguucgagagcguggccugguccgccagcgcgugccacgacgggaucaacuggcucaccaucggcaucuccggccccgacaacggggccgucgccgugcugaaguacaacggcaucaucaccgacacgaucaagagcuggcgcaacaacauccugcggacccaggaguccgagugcgccugcgugaacgggucgugcuucaccgucaugaccgacggcccguccaacggccaggcgagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcacggacaacaacuucucgaucaagcaggacaucguggggaucaacgagugguccggcuacagcggguccuucguccagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgccgagcugccguucaccaucgacaaguga

SEQ ID NO: 26140 - RNA, 1413 nt, Artificial Sequence; identical to SEQ ID NO: 21332
  derived and/or modified CDS sequence (AUadapt) from InfluenzaA__AGR49820__NA

SEQ ID NO: 26141 - RNA, 1410 nt, Artificial Sequence; identical to SEQ ID NO: 18492
  derived and/or modified CDS sequence (AUadapt) from InfluenzaA__AGR49832__NA

SEQ ID NO: 26142 - RNA, 1413 nt, Artificial Sequence; identical to SEQ ID NO: 21332
  derived and/or modified CDS sequence (AUadapt) from InfluenzaA__AGR49844__NA

SEQ ID NO: 26143 - RNA, 1413 nt, Artificial Sequence; identical to SEQ ID NO: 21332
  derived and/or modified CDS sequence (AUadapt) from InfluenzaA__AGR49856__NA

SEQ ID NO: 26144 - RNA, 1413 nt, Artificial Sequence; identical to SEQ ID NO: 21332
  derived and/or modified CDS sequence (AUadapt) from InfluenzaA__AGR49868__NA

SEQ ID NO: 26145 - RNA, 1410 nt, Artificial Sequence; identical to SEQ ID NO: 16274
  derived and/or modified CDS sequence (AUadapt) from InfluenzaA__AGR49880__NA

SEQ ID NO: 26146 - RNA, 1410 nt, Artificial Sequence; identical to SEQ ID NO: 20886
  derived and/or modified CDS sequence (AUadapt) from InfluenzaA__AGR49891__NA

SEQ ID NO: 26147 - RNA, 1410 nt, Artificial Sequence
  derived and/or modified CDS sequence (AUadapt) from InfluenzaA__AGR49903__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcgccugguggacuccaucgugucgugguccaaggagauccugcggacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgcuaccccggcgugcggugcgucugccgcgacaacuggaaggggagcaaccggccgaucguggacaucaacaucaaggaccacuccaucgugucguccuacgucugcagcggccuggugggcgacacgccccgcaagaacgacuccucguccagcgggcacugccucgaccccaacaacgaggagggcgggcacggcgugaaggggugggccuucgacgacggcaacgacgucuggaugggccggaccaucuccgagaagucccgccugggguacgagaccuucaaggugaucgagggcuggucgaaccccaagagcaagcugcagaucaaccggcaggucaucguggaccgcgggaaccgguccggcuacucggggaucuucuccguggagggcaagagcugcaucaaccgcugcuucuacgucgagcucauccggggccgcaaggaggagaccgaggugcuguggaccucgaacuccaucguggucuucugcgggaccagcggcacguacgggaccggcuccuggccggacggggccgacaucaaccugaugcccaucuga

SEQ ID NO: 26148 - RNA, 1410 nt, Artificial Sequence; identical to SEQ ID NO: 18492
  derived and/or modified CDS sequence (AUadapt) from InfluenzaA__AGR49915__NA

SEQ ID NO: 26149 - RNA, 1410 nt, Artificial Sequence; identical to SEQ ID NO: 18492
  derived and/or modified CDS sequence (AUadapt) from InfluenzaA__AGR49927__NA

SEQ ID NO: 26150 - RNA, 1410 nt, Artificial Sequence
  derived and/or modified CDS sequence (AUadapt) from InfluenzaA__AGR49939__NA
augaaccccaacaagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcgggcacugccucgaccccaacaacgaggagggcgggcacggcgugaaggggugggccuucgacgacggcaacgacgucuggaugggccgcaccaucuccgagaagucccggcugggguacgagaccuucaaggugaucgagggcuggucgaaccccaagagcaagcugcagaucaaccgccaggucaucguggaccgggggaaccgcuccggcuacucggggaucuucuccguggagggcaagagcugcaucaaccggugcuucuacgucgagcucauccgcggccggaaggaggagaccgaggugcuguggaccucgaacuccaucguggucuucugcgggaccagcggcacguacgggaccggcuccuggccggacggggccgacaucaaccugaugcccaucuga

SEQ ID NO: 26151 - RNA, 1410 nt, Artificial Sequence; identical to SEQ ID NO: 19087
  derived and/or modified CDS sequence (AUadapt) from InfluenzaA__AGR49951__NA

SEQ ID NO: 26152 - RNA, 1410 nt, Artificial Sequence
  derived and/or modified CDS sequence (AUadapt) from InfluenzaA__AGR49963__NA
augaaccccaacaagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcgggcacugccucgaccccaacaacgaggagggcgggcacggcgugaaggggugggccuucgacgacggcaacgacgucuggaugggccgcaccaucuccaagaagucccggcugggguacgagaccuucaaggugaucgagggcuggucgaaccccaagagcaagcugcagaucaaccgccaggucaucguggaccgggggaaccgcuccggcuacucggggaucuucuccguggagggcaagagcugcaucaaccggugcuucuacgucgagcucauccgcggccggaaggaggagaccgaggugcuguggaccucgaacuccaucguggucuucugcgggaccagcggcacguacgggaccggcuccuggccggacggggccgacaucaaccugaugcccaucuga

SEQ ID NO: 26153 - RNA, 1410 nt, Artificial Sequence; identical to SEQ ID NO: 16274
  derived and/or modified CDS sequence (AUadapt) from InfluenzaA__AGR49975__NA

SEQ ID NO: 26154 - RNA, 1413 nt, Artificial Sequence; identical to SEQ ID NO: 21332
  derived and/or modified CDS sequence (AUadapt) from InfluenzaA__AGR49986__NA

SEQ ID NO: 26155 - RNA, 1413 nt, Artificial Sequence; identical to SEQ ID NO: 21332
  derived and/or modified CDS sequence (AUadapt) from InfluenzaA__AGR49998__NA

SEQ ID NO: 26156 - RNA, 1410 nt, Artificial Sequence; identical to SEQ ID NO: 16274
  derived and/or modified CDS sequence (AUadapt) from InfluenzaA__AGR50010__NA

SEQ ID NO: 26157 - RNA, 1410 nt, Artificial Sequence; identical to SEQ ID NO: 16274
  derived and/or modified CDS sequence (AUadapt) from InfluenzaA__AGR50021__NA

SEQ ID NO: 26158 - RNA, 1410 nt, Artificial Sequence; identical to SEQ ID NO: 16318
  derived and/or modified CDS sequence (AUadapt) from InfluenzaA__AGR50032__NA

SEQ ID NO: 26159 - RNA, 1410 nt, Artificial Sequence
  derived and/or modified CDS sequence (AUadapt) from InfluenzaA__AGR50043__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggacauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgaccugaaccucaugcccaucuga

SEQ ID NO: 26160 - RNA, 1410 nt, Artificial Sequence; identical to SEQ ID NO: 16274
  derived and/or modified CDS sequence (AUadapt) from InfluenzaA__AGR50055__NA

SEQ ID NO: 26161 - RNA, 1410 nt, Artificial Sequence
  derived and/or modified CDS sequence (AUadapt) from InfluenzaA__AGR50066__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccgucaugaccgacggcccguccaacggccaggccagcuacaagaucuucaagaucgagaaggggaagaucgugaaguccguggagaugaacgcccccaacuaccacuacgaggagugcagcugcuaccccgacuccagcgagaucacgugcgucugccgcgacaacuggcacggcuccaaccggcccugggugucguucaaccagaaccucgaguaccagaucggguacaucugcuccggcaucuucggggacaacccgcgccccaacgacaagaccggcagcugcggccccguguccagcaacggggccaacggcgucaagggguucuccuucaaguacggcaacgggguguggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 26162 - RNA, 1410 nt, Artificial Sequence; identical to SEQ ID NO: 16274
  derived and/or modified CDS sequence (AUadapt) from InfluenzaA__AGR50077__NA

SEQ ID NO: 26163 - RNA, 1410 nt, Artificial Sequence; identical to SEQ ID NO: 16274
  derived and/or modified CDS sequence (AUadapt) from InfluenzaA__AGR50088__NA

SEQ ID NO: 26164 - RNA, 1410 nt, Artificial Sequence; identical to SEQ ID NO: 16274
  derived and/or modified CDS sequence (AUadapt) from InfluenzaA__AGR50099__NA

SEQ ID NO: 26165 - RNA, 1410 nt, Artificial Sequence; identical to SEQ ID NO: 16274
  derived and/or modified CDS sequence (AUadapt) from InfluenzaA__AGR50110__NA

SEQ ID NO: 26166 - RNA, 1410 nt, Artificial Sequence
  derived and/or modified CDS sequence (AUadapt) from InfluenzaA__AGR50121__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgucggccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccgugcccuccaacggggccaacggcgucaagggguucucguucaaguacggcaacgggguguggaucggccgcaccaaguccaucagcagccggaacggcuucgagaugaucugggacccgaacggguggaccggcaccgacaacaacuucuccaucaagcaggacaucguggggaucaacgaguggagcggcuacuccgggucguucguccagcaccccgagcugacgggccuggacugcauccgccccugcuucuggguggagcucauccggggccgccccaaggagaacaccaucuggaccuccgggagcuccaucagcuucugcggcgucaacuccgacaccgugggguggagcuggccggacggcgccgagcugcccuucacgaucgacaaguga

SEQ ID NO: 26167 - RNA, 1410 nt, Artificial Sequence
  derived and/or modified CDS sequence (AUadapt) from InfluenzaA__AGR50132__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgucggccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgccaacgggagcugcuucaccgugaugaccgacggcccguccaacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgcggagcugccguucacgaucgacaaguga

SEQ ID NO: 26168 - RNA, 1410 nt, Artificial Sequence; identical to SEQ ID NO: 16274
  derived and/or modified CDS sequence (AUadapt) from InfluenzaA__AGR50143__NA

SEQ ID NO: 26169 - RNA, 1410 nt, Artificial Sequence; identical to SEQ ID NO: 16274
  derived and/or modified CDS sequence (AUadapt) from InfluenzaA__AGR50154__NA

SEQ ID NO: 26170 - RNA, 1413 nt, Artificial Sequence; identical to SEQ ID NO: 21332
  derived and/or modified CDS sequence (AUadapt) from InfluenzaA__AGR50165__NA

SEQ ID NO: 26171 - RNA, 1410 nt, Artificial Sequence; identical to SEQ ID NO: 16274
  derived and/or modified CDS sequence (AUadapt) from InfluenzaA__AGR50177__NA

SEQ ID NO: 26172 - RNA, 1410 nt, Artificial Sequence; identical to SEQ ID NO: 16274
  derived and/or modified CDS sequence (AUadapt) from InfluenzaA__AGR50188__NA

SEQ ID NO: 26173 - RNA, 1410 nt, Artificial Sequence; identical to SEQ ID NO: 16274
  derived and/or modified CDS sequence (AUadapt) from InfluenzaA__AGR50199__NA

SEQ ID NO: 26174 - RNA, 1410 nt, Artificial Sequence; identical to SEQ ID NO: 16274
  derived and/or modified CDS sequence (AUadapt) from InfluenzaA__AGR50210__NA

SEQ ID NO: 26175 - RNA, 1410 nt, Artificial Sequence; identical to SEQ ID NO: 16274
  derived and/or modified CDS sequence (AUadapt) from InfluenzaA__AGR50221__NA

SEQ ID NO: 26176 - RNA, 1410 nt, Artificial Sequence
  derived and/or modified CDS sequence (AUadapt) from InfluenzaA__AGR50232__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcucgccccuggagugccgcaccuucuuccugacccagggcgcccuccugaacgacaagcacagcaacgggaccaucaaggaccggucccccuaccgcacgcugaugagcugcccgaucggcgaggugcccucccccuacaacagccgguucgagucgguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccgaacaacggccaggccuccuacaagaucuuccgcaucgagaaggggaagaucgugaaguccguggagaugaacgcccccaacuaccacuacgaggagugcuccugcuaccccgacucguccgagaucacgugcgucugccgggacaacuggcacggcagcaaccgccccuggguguccuucaaccagaaccucgaguaccagaucggguacaucugcagcggcaucuucggggacaacccgcggcccaacgacaagaccggcuccugcggccccgugagcuccaacggggccaacggcgucaagggguucucguucaaguacggcaacgggguguggaucggccgcaccaaguccaucagcagccggaacggcuucgagaugaucugggaccccaacggguggaccggcaccgacaacaacuucuccaucaagcaggacaucguggggaucaacgaguggagcggcuacuccgggucguucguccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 26177 - RNA, 1410 nt, Artificial Sequence; identical to SEQ ID NO: 16274
  derived and/or modified CDS sequence (AUadapt) from InfluenzaA__AGR50243__NA

SEQ ID NO: 26178 - RNA, 1410 nt, Artificial Sequence; identical to SEQ ID NO: 16274
  derived and/or modified CDS sequence (AUadapt) from InfluenzaA__AGR50254__NA

SEQ ID NO: 26179 - RNA, 1410 nt, Artificial Sequence; identical to SEQ ID NO: 16274
  derived and/or modified CDS sequence (AUadapt) from InfluenzaA__AGR50265__NA

SEQ ID NO: 26180 - RNA, 1410 nt, Artificial Sequence
  derived and/or modified CDS sequence (AUadapt) from InfluenzaA__AGR50276__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcggagcagagcgucguguccgugaagcuggccggcaacucgucccucugcccggucagcgggugggccaucuacuccaaggacaacagcgugcgcaucggcuccaagggcgacguguucgucauccgggagcccuucaucagcugcagcccccuggagugccgcaccuucuuccugacccagggggcccuccugaacgacaagcacuccaacggcaccaucaaggaccggucccccuaccgcacgcugaugucgugcccgaucggggaggugcccucccccuacaacagccgguucgagagcguggccugguccgcgagcgccugccacgacggcaucaacuggcucaccaucgggaucuccggccccgacaacggcgccgucgccgugcugaaguacaacgggaucaucaccgacaccaucaagagcuggcgcaacaacauccugcggacgcaggaguccgagugcgcgugcgugaacggcucgugcuucaccgucaugaccgacgggccguccaacggccaggccagcuacaagaucuuccgcaucgagaagggcaagaucgugaaguccguggagaugaacgcccccaacuaccacuacgaggagugcagcugcuaccccgacuccagcgagaucacgugcgucugccgggacaacuggcacggguccaaccgccccugggugucguucaaccagaaccucgaguaccagaucggcuacaucugcuccgggaucuucggcgacaacccgcggcccaacgacaagaccgggagcugcggccccguguccagcaacggcgccaacggggucaagggcuucuccuucaaguacgggaacggcguguggaucgggcgcaccaagagcaucagcucccggaacggcuucgagaugaucugggaccccaacggcuggaccgggaccgacaacaacuucucgaucaagcaggacaucgugggcaucaacgagugguccggguacagcggcuccuucguccagcacccggagcugacggggcuggacugcauccgccccugcuucuggguggagcucauccggggccgccccaaggagaacaccaucuggaccagcggcuccagcaucuccuucugcggggucaacagcgacaccgugggcugguccuggcccgacggggccgagcugccguucacgaucgacaaguga

SEQ ID NO: 26181 - RNA, 1410 nt, Artificial Sequence; identical to SEQ ID NO: 16274
  derived and/or modified CDS sequence (AUadapt) from InfluenzaA__AGR50287__NA

SEQ ID NO: 26182 - RNA, 1410 nt, Artificial Sequence
  derived and/or modified CDS sequence (AUadapt) from InfluenzaA__AGR50298__NA
augaaccccaaccagaagaucaucaccaucggcucggugugcaugaccaucgggauggccaaccugauccuccagaucggcaacacgaucuccaucuggaucagccacuccauccagccggggaaccagaaccagaucgagaccugcaaccagagcgucaucaccuacgagaacaacaccugggugaaccagacguacgugaacaucuccaacaccaacuucgccgcgggccagucggucguguccgugaagcuggccgggaacagcucccugugccccgucagcggcugggccaucuacuccaaggacaacagcauccgcaucggcuccaagggggacguguucgugauccgggagcccuucaucucgugcagcccccucgagugccgcaccuucuuccugacccagggcgcccugcucaacgacaagcacuccaacgggacgaucaaggaccgguccccguaccgcacccugaugagcugccccaucggcgagguccccucccccuacaacucgcgguucgagagcguggccugguccgcgagcgccugccacgacgggaucaacuggcugaccaucggcaucuccggcccggacaacggggccguggccguccucaaguacaacggcaucaucaccgacacgaucaagagcuggcgcaacaacauccugcggacccaggaguccgagugcgcgugcgugaacgggucgugcuucaccgugaugaccgacggccccuccgacggccaggccagcuacaagaucuuccgcaucgagaaggggaagaucgucaaguccguggagaugaacgcccccaacuaccacuacgaggagugcagcugcuaccccgacuccucggagaucacgugcgugugccgggacaacuggcacggcuccaaccgcccgugggucagcuucaaccagaaccuggaguaccagaucggguacaucugcuccggcaucuucggggacaacccccggcccaacgacaagaccggcagcugcggccccguguccagcaacggggccaacggcgugaagggguucuccuucaaguacggcaacggggucuggaucggccgcaccaagucgaucagcucccggaacggcuucgagaugaucugggacccgaacggguggaccggcacggacaacaacuucagcaucaagcaggacaucguggggaucaacgagugguccggcuacucgggguccuucgugcagcaccccgagcucaccggccuggacugcauccgccccugcuucugggucgagcugauccggggccgccccaaggagaacaccaucuggaccagcggguccagcaucuccuucugcggcgugaacagcgacacggucgggugguccuggccggacggcgccgagcuccccuucaccaucgacaaguga

SEQ ID NO: 26183 - RNA, 1410 nt, Artificial Sequence; identical to SEQ ID NO: 16274
  derived and/or modified CDS sequence (AUadapt) from InfluenzaA__AGR50309__NA

SEQ ID NO: 26184 - RNA, 1410 nt, Artificial Sequence; identical to SEQ ID NO: 16274
  derived and/or modified CDS sequence (AUadapt) from InfluenzaA__AGR50320__NA

SEQ ID NO: 26185 - RNA, 1410 nt, Artificial Sequence; identical to SEQ ID NO: 16274
  derived and/or modified CDS sequence (AUadapt) from InfluenzaA__AGR50331__NA

SEQ ID NO: 26186 - RNA, 1410 nt, Artificial Sequence
  derived and/or modified CDS sequence (AUadapt) from InfluenzaA__AGR50342__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucaucuccgugaagcuggccgggaacucgucccucugcccggugagcggcugggccaucuacuccaaggacaacagcguccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccaacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 26187 - RNA, 1410 nt, Artificial Sequence; identical to SEQ ID NO: 16274
  derived and/or modified CDS sequence (AUadapt) from InfluenzaA__AGR50353__NA

SEQ ID NO: 26188 - RNA, 1413 nt, Artificial Sequence; identical to SEQ ID NO: 21332
  derived and/or modified CDS sequence (AUadapt) from InfluenzaA__AGR50364__NA

SEQ ID NO: 26189 - RNA, 1410 nt, Artificial Sequence
  derived and/or modified CDS sequence (AUadapt) from InfluenzaA__AGR55170__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaacuccaagcugcagaucaaccgccagaucaucgucgaccggggcaaccgcucgggguacuccggcaucuucagcguggagggcaagucgugcaucaaccggugcuucuacguggagcucauccgcgggcggaaggaggagaccgagguccuguggaccuccaacagcaucgugguguucugcggcaccuccgggacguacggcaccgggagcuggccggacggcgccgacaucaaccugaugcccaucuga

SEQ ID NO: 26190 - RNA, 1410 nt, Artificial Sequence; identical to SEQ ID NO: 16547
  derived and/or modified CDS sequence (AUadapt) from InfluenzaA__AGR55180__NA

SEQ ID NO: 26191 - RNA, 1410 nt, Artificial Sequence; identical to SEQ ID NO: 16547
  derived and/or modified CDS sequence (AUadapt) from InfluenzaA__AGR55181__NA

SEQ ID NO: 26192 - RNA, 1410 nt, Artificial Sequence; identical to SEQ ID NO: 16547
  derived and/or modified CDS sequence (AUadapt) from InfluenzaA__AGR55183__NA

SEQ ID NO: 26193 - RNA, 1410 nt, Artificial Sequence
  derived and/or modified CDS sequence (AUadapt) from InfluenzaA__AGR55184__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaagaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcacggggagcuggccggacggcgccgacaucaaccugaugcccaucuga

SEQ ID NO: 26194 - RNA, 1410 nt, Artificial Sequence
  derived and/or modified CDS sequence (AUadapt) from InfluenzaA__AGR55185__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaagaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccucccgcaccuacgggacgggcagcuggccggacggggccgacaucaaccugaugcccaucuga

SEQ ID NO: 26195 - RNA, 1410 nt, Artificial Sequence
  derived and/or modified CDS sequence (AUadapt) from InfluenzaA__AGR55186__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgagcccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaagcaggagaccgaggugcuguggaccuccaacagcaucgucguguucugcggcaccuccgggacguacggcaccgggagcuggccggacggcgccgacaucaaccugaugcccaucuga

SEQ ID NO: 26196 - RNA, 1410 nt, Artificial Sequence; identical to SEQ ID NO: 16547
  derived and/or modified CDS sequence (AUadapt) from InfluenzaA__AGR55187__NA

SEQ ID NO: 26197 - RNA, 1410 nt, Artificial Sequence; identical to SEQ ID NO: 17116
  derived and/or modified CDS sequence (AUadapt) from InfluenzaA__AGR55192__NA

SEQ ID NO: 26198 - RNA, 1410 nt, Artificial Sequence
  derived and/or modified CDS sequence (AUadapt) from InfluenzaA__AGR55195__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccucguucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgagcacccuguccgggucggcgcagcacguggaggagugcuccugcuacccccgcuaccccggcguccggugcgugugccgcgaccacuggaaggggagcaaccggccgaucguggacaucaacaucaaggacuacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucagcgagaagcugcgccugggcuacgagaccuucaaggucaucgaggggugguccaaccccaacucgaagcuccagaucaaccgccaggugaucguggaccggggcaaccgguccggguacagcggcaucuucuccgucgagggcaagucgugcaucaaccgcugcuucuacguggagcugauccgggggcgcaaggaggagaccgaggugcuguggaccagcaacuccaucgucguguucugcggcaccagcgggacguacggcaccggguccuggccggacggcgccgacaucaaccucaugcccaucuga

SEQ ID NO: 26199 - RNA, 1410 nt, Artificial Sequence
  derived and/or modified CDS sequence (AUadapt) from InfluenzaA__AGR55204__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcgaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccucccgcacguacgggaccggcagcuggccggacggggccgacaucaaccugaugcccaucuga

SEQ ID NO: 26200 - RNA, 1410 nt, Artificial Sequence
  derived and/or modified CDS sequence (AUadapt) from InfluenzaA__AGR55218__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccagguggugcugugcgagcccacgaucaucgagcgcaacaucaccgagaucgucuaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 26201 - RNA, 1410 nt, Artificial Sequence; identical to SEQ ID NO: 25791
  derived and/or modified CDS sequence (AUadapt) from InfluenzaA__AGT18726__NA

SEQ ID NO: 26202 - RNA, 1410 nt, Artificial Sequence
  derived and/or modified CDS sequence (AUadapt) from InfluenzaA__AGT18727__NA
augaaccccaaccagaagaucaucaccaucggcucggugugcaugaccaucgggauggccaaccugauccuccagaucggcaacaucaucuccaucuggaucagccacuccauccagcuggggagccagaaccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacucgaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccguggccuggucggcguccgccugccacgacgggaucaacuggcucaccaucggcaucagcggccccgacuccggggccgucgccgugcugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgucaaguccguggagaugaacgcccccaacuaccacuacgaggagugcagcugcuaccccgacuccucggagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucagcuucaaguacggcaacggggucuggaucggccgcaccaaguccaucagcucccggaagggcuucgagaugaucugggaccccaacggguggucgggcaccgacaacaacuucuccaucaagcaggacaucguggggaucaacgaguggagcggcuacuccgggagcuucgugcagcacccggagcugaccggccuggacugcauccgccccugcuucugggucgagcucauccggggccgccccaaggagaacacgaucuggaccuccgggagcuccaucagcuucugcggcgugaacuccgacaccgucggguggagcuggcccgacggcgccgagcugccguucaccaucgacaaguga

SEQ ID NO: 26203 - RNA, 1410 nt, Artificial Sequence; identical to SEQ ID NO: 25791
  derived and/or modified CDS sequence (AUadapt) from InfluenzaA__AGT18728__NA

SEQ ID NO: 26204 - RNA, 1410 nt, Artificial Sequence
  derived and/or modified CDS sequence (AUadapt) from InfluenzaA__AGT18729__NA
augaaccccaaccagaagaucaucaccaucggccaggugugcaugaccaucgggauggccaaccugauccuccagaucggcaacaucaucucgaucuggaucucccacagcauccagcuggggucccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacagcggggccgucgccgugcugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaagggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 26205 - RNA, 1410 nt, Artificial Sequence
  derived and/or modified CDS sequence (AUadapt) from InfluenzaA__AGT18730__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacucgcgguucgaguccguggccuggagcgcguccgccugccacgacgggaucaacuggcucaccaucggcaucagcggccccgacuccggggccgucgccgugcugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgucaaguccguggagaucaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucagcuucaaguacggcaacggggucuggaucggccgcaccaaguccaucucgucccggaagggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 26206 - RNA, 1410 nt, Artificial Sequence; identical to SEQ ID NO: 25791
  derived and/or modified CDS sequence (AUadapt) from InfluenzaA__AGT18731__NA

SEQ ID NO: 26207 - RNA, 1410 nt, Artificial Sequence
  derived and/or modified CDS sequence (AUadapt) from InfluenzaA__AGT18732__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgaggugcccagccccuacaacagccgguucgaguccguggccuggagcgcguccgccugccacgacgggaucaacuggcucaccaucggcaucagcggccccgacuccggggccgucgccgugcugaaguacaacggcaucaucaccgacaccaucaagucguggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucagcuucaaguacggcaacggggucuggaucggccgcaccaaguccaucagcucccggaagggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggacccgggggagcuccaucagcuucugcggcgugaacuccgacaccgucggguggagcuggcccgacggcgccgagcugccguucacgaucgacaaguga

SEQ ID NO: 26208 - RNA, 1410 nt, Artificial Sequence
  derived and/or modified CDS sequence (AUadapt) from InfluenzaA__AGT18733__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccgugcgcaucggcagcaagggggacguguucgucauccgggagcccuucaucuccugcucgccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccguggccuggucggcguccgccugccacgacgggaucaacuggcucaccaucggcaucagcggccccgacuccggggccgucgccgugcugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgucaaguccguggagaugaacgcccccaacuaccacuacgaggagugcucgugcuaccccgacuccagcgaguccacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugucgagcaacggggccaacggcgugaagggguucuccuucaaguacggcaacggggucuggaucggccgcaccaagagcaucuccagccggaagggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcucccggagcuucugcggcgugaacuccgacaccgucggguggagcuggcccgacggcgccgagcugccguucacgaucgacaaguga

SEQ ID NO: 26209 - RNA, 1410 nt, Artificial Sequence
  derived and/or modified CDS sequence (AUadapt) from InfluenzaA__AGT18762__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugacgcugugcgagcccaucaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 26210 - RNA, 1410 nt, Artificial Sequence
  derived and/or modified CDS sequence (AUadapt) from InfluenzaA__AGT18764__NA
augaaccccaaccagaugaucaucaccaucggcucggugucccugaccucguccacgaucugcuucuucaugcagaccgccagcuucaucaccaccgucacgcuccacaucaagcagcacgaguuccacuccccgcccaacaaccaggugaugcugugcgagcccaccaucaucgagcgcaacaucaccgagaucguguaccugaccaacacgaccaucgagaaggagaucugccccaagcucgccgaguaccggaacuggucgaagccgcagugcgacaucaccggguucgcgcccuucuccaaggacaacucgauccgccuguccgccggcggggacaucugggucacccgggagcccuacgugagcugcgaccccgacaagugcuaccaguucgcccugggccaggggacgacccucaacaacgugcacuccaacaacaccguccgcgaccggaccccguaccgcacgcugcugaugaacgagcucggcgugcccuuccaccugggcaccaagcaggucugcaucgccuggucguccagcuccugccacgacgggaaggccuggcugcacgugugcaucaccggcgacgacaagaacgcgaccgccucguucaucuacaacgggaagcucguggacuccguggucucgugguccaaggagauccugcggacgcaggagagcgagugcgugugcaucaacgggaccugcaccguggucaugaccgacgggucggccuccggcaaggccgacacgaagauccuguucaucgaggagggcaagaucgugcacaccucgacccucuccgggagcgcgcagcacguggaggagugcuccugcuacccccgcuaccccggcguccggugcgugugccgcgacaacuggaaggggucgaaccggccgaucguggacaucaacaugaaggaccacuccaucgucagcuccuacgugugcucgggccuggugggcgacacgccccgcaagaacgaccgguccucgaacucccacugccuggaccccaacaacgaggagggcggccacggggucaagggcugggccuucgacgacgggaacgacguguggaugggccgcaccaucaacgagaccagccggcucggcuacgagaccuucaaggucaucgaggggugguccaaccccaagucgaagcugcagaucaaccgccaggugaucguggaccggggcaaccgcuccggguacucgggcaucuucuccgucgagggcaagagcugcaucaaccggugcuucuacguggagcugauccgcgggcggaaggaggagaccgaggugcucuggacgucgaacuccaucgucguguucugcggcaccagcgggaccuacggcaccggguccuggccggacggcgccgaccugaaccugaugcccaucuga

SEQ ID NO: 26211 - RNA, 1410 nt, Artificial Sequence
  derived and/or modified CDS sequence (AUadapt) from InfluenzaA__AGT18765__NA
augaaccccaaccagaagaucaucaccaucggcucggugucccugaccaucucgacgaucugcuucuucaugcagaucgccauccucaucaccaccgucacccugcacuucaagcagcacgaguuccacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaugaaggaccacuccaucgucucguccuacgugugcagcggccuggugggcgacacgccccggaagaacgaccgcuccucgaacucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagucgaagcugcagaucaaccgccaggugaucguggaccggggcaaccgguccggguacucgggcaucuucuccgucgagggcaagagcugcaucaaccgcugcuucuacguggagcucauccgggggcgcaaggaggagaccgaggugcuguggaccuccaacucgaucgucguguucugcggcacgagcgggaccuacggcaccggguccuggccggacggcgccgaccugaaccucaugcccaucuga

SEQ ID NO: 26212 - RNA, 1410 nt, Artificial Sequence
  derived and/or modified CDS sequence (AUadapt) from InfluenzaA__AGT18766__NA
augaaccccaaccagaagaucaucaccaucggcucggugucccugaccaucucgacgaucugccucuucaugcagaucgccauccugaucaccaccgucacccugcacuucaagcagcacgaguuccacuccccgcccaacaaccaggugaugcucugcgagcccacgaucaucgagcgcaacaucaccgagaucguguaccugaccaacaccacgaucgagaaggagaucugccccaagcuggccgaguaccggaacuggucgaagccgcagugcgacaucaccggguucgcgcccuucuccaaggacaacagcauccgccucuccgccggcggggacaucugggucacccgggagcccuacgugucgugcgaccccgacaagugcuaccaguucgcccugggccaggggaccacgcugaacaacgugcacuccaacaacaccguccgcgaccggaccccguaccgcacccuccugaugaacgagcugggcgugcccuuccaccucggcacgaagcaggucugcaucgccuggucguccagcuccugccacgacgggaaggccuggcugcacgugugcaucaccggcgacgacaagaacgcgaccgccucguucaucuacaacgggcggcugguggacuccguggucucgugguccaaggagauccuccgcacccaggagagcgagugcgugugcaucaacggcacgugcaccguggucaugaccgacggguccgccucgggcaaggccgacaccaagauccuguucaucgaggagggcaagaucgugcacacgucgacccuguccgggucggcgcagcacguggaggagugcuccugcuacccccgguaccccggcguccgcugcgugugccgggacaacuggaaggggagcaaccgcccgaucguggacaucaacaugaaggaccacuccaucgucucguccuacgugugcucgggccucgugggcgacacgccccggaagaacgaccgcuccagcaacucccacugccuggaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagucgaagcuccagaucaaccgccaggugaucguggaccggggcaaccgguccggguacagcggcaucuucuccgucgagggcaagucgugcaucaaccgcugcuucuacguggagcugauccgggggcgcaaggaggagaccgaggugcuguggaccuccaacucgaucgucguguucugcggcacgagcgggaccuacggcaccggguccuggccggacggcgccgaccucaaccugaagcccaucuga

SEQ ID NO: 26213 - RNA, 1410 nt, Artificial Sequence
  derived and/or modified CDS sequence (AUadapt) from InfluenzaA__AGT18767__NA
augaaccccaaccagaagaucaucaccaucggcucggugucccugaccaucucgacgaucugcuucuucaugcagaccgccucccucaucaccaccgucacgcugcacuucaagcagcacgaguuccacagcccgcccaacaaccaggugaugcugugcgagcccaccaucaucgagcgcaacaucaccgagaucguguaccucaccaacacgaccaucgagaaggagaucugccccaagcuggccgaguaccggaacugguccaagccgcagugcgacaucaccggguucgcgcccuucucgaaggacaacuccauccgccugucggccggcggggacaucugggucacccgggagcccuacguguccugcgaccccgacaagugcuaccaguucgcccucggccaggggacgacccugaacaacgugcacagcaacaacaccguccgcgaccggaccccguaccgcacgcugcucaugaacgagcugggcgugcccuuccaccugggcaccaagcaggucugcaucgccugguccucguccucgugccacgacgggaaggccuggcuccacgugugcaucaccggcgacgacaagaacgcgaccgccuccuucaucuacaacgggcggcugguggacagcguggucuccuggucgaaggagauccugcgcacgcaggaguccgagugcgugugcaucaacgggaccugcaccguggucaugaccgacgggucggccagcggcaaggccgacacgaagauccucuucaucgaggagggcaagaucgugcacaccuccacccugucgggguccgcgcagcacguggaggagugcucgugcuacccccgguaccccggcguccgcugcgugugccgggacaacuggaagggguccaaccgcccgaucguggacaucaacaugaaggaccacagcaucgucuccucguacgugugcuccggccuggugggcgacacgccccggaagaacgaccgcucguccaacagccacugccucgaccccaacaacgaggagggcggccacggggucaagggcugggccuucgacgacgggaacgacguguggaugggccggaccaucaacgagaccucccgccugggcuacgagaccuucaaggucaucgagggguggucgaaccccaaguccaagcugcagaucaaccgccaggugaucguggaccggggcaaccggucgggguacuccggcaucuucagcgucgaggggaaguccugcaucaaccgcugcuucuacguggagcucauccggggccgcaaggaggagaccgaggugcuguggacgucgaacucgaucgucguguucugcggcaccuccgggaccuacggcaccgggagcuggccggacggcgccgaccugaaccucaugcccaucuga

SEQ ID NO: 26214 - RNA, 1410 nt, Artificial Sequence
  derived and/or modified CDS sequence (AUadapt) from InfluenzaA__AGT18768__NA
augaaccccaaccagaagaucaucaccaucggcucggugucccugaccaucucgacgaucugcuucuucaugcagaccgccuccuucaucaccaccgucacgcuccacuucaagcaguacgaguucaacagcccgcccaacaaccaggugaugcugugcgagcccaccaucaucgagcgcaacaucaccgagaucguguaccugaccaacacgaccaucgagaaggagaucugccccaagcucgccgaguaccggaacugguccaagccgcagugcgacaucaccggguucgcgcccuucucgaaggacaacuccauccgccugagcgccggcggggacaucugggucacccgggagcccuacguguccugcgaccccgacaagugcuaccaguucgcccugggccaggggacgacccucaacaacgugcacucgaacaacaccguccgcgaccggaccccguaccgcacgcugcugaugaacgagcucggcgugcccuuccaccugggcaccaagcaggucugcaucgccugguccucguccagcugccacgacgggaaggccuggcugcacgugugcaucaccggcgacgacaagaacgcgaccgccuccuucaucuacaacgggcggcucguggacucgguggucuccuggagcaaggagauccugcgcacgcaggaguccgagugcgugugcaucaacgggaccugcaccguggucaugaccgacgggucggccagcggcaaggccgacacgaagauccuguucaucgaggagggcaagaucgugcacaccuccacccucucgggguccgcgcagcacguggaggagugcucgugcuacccccgguaccccggcguccgcugcgugugccgggacaacuggaagggguccaaccgcccgaucguggacaucaacaugaaggaccacagcaucgucuccucguacgugugcuccggccuggugggcgacacgccccggaagaacgaccgcagcuccaacucgcacugccuggaccccaacaacgaggagggcggccacggggucaagggcugggccuucgacgacgggaacgacguguggaugggccggaccaucaacgagaccucccgccucggcuacgagaccuucaaggucaucgagggguggucgaaccccaaguccaagcugcagaucaaccgccaggugaucguggaccggggcaaccggagcggguacuccggcaucuucucggucgaggggaaguccugcaucaaccgcugcuucuacguggagcugauccggggccgcaaggaggagaccgaggugcucuggacgagcaacucgaucgucguguucugcggcaccuccgggaccuacggcaccgggagcuggccggacggcgccgaccugaaccugaugcccaucuga

SEQ ID NO: 26215 - RNA, 1410 nt, Artificial Sequence; identical to SEQ ID NO: 16339
  derived and/or modified CDS sequence (AUadapt) from InfluenzaA__AGT18769__NA

SEQ ID NO: 26216 - RNA, 1410 nt, Artificial Sequence
  derived and/or modified CDS sequence (AUadapt) from InfluenzaA__AGT18770__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaacaaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 26217 - RNA, 1410 nt, Artificial Sequence
  derived and/or modified CDS sequence (AUadapt) from InfluenzaA__AGT18771__NA
augaaccccaaccagaagaucaucaccaucggcucggugucccugaccaucucgacgaucugcuucuucaugcagaucgccauccucaucaccaccgucacccugcacuucaagcaguacaaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 26218 - RNA, 1410 nt, Artificial Sequence; identical to SEQ ID NO: 16339
  derived and/or modified CDS sequence (AUadapt) from InfluenzaA__AGT18772__NA

SEQ ID NO: 26219 - RNA, 1410 nt, Artificial Sequence
  derived and/or modified CDS sequence (AUadapt) from InfluenzaA__AGT37104__NA
augaaccccaaccagaagaucaucaccaucggcucggugucccugaccaucgccacgaucugccuccugaugcagaucgccauccuggucaccaccgugacccuccacuucaagcaguacgagugcucguccccgcccaacaaccaggugaugcccugcgagcccacgaucaucgagcgcaacaucaccaagaucgucuaccugaccaacaccacgaucgagcgggaggcgugcccggagcuggccgaguaccgccacuggagcaagccccagugcaagauccggggguucgcccccuucuccaaggacaacucgauccgccucuccgccggcggggacaucugggugacccgggagcccuacgugucgugcgacccgggcaagugcuaccaguucgcccuggggcagggcaccacccugaacaaccgccacuccaacgacacgguccacgaccggacccccuaccgcacccuccugaugaacgagcugggcgugcccuuccaccucgggaccaagcaggucugcaucgcguggagcuccucguccugccacgacggcaaggccuggcugcacgugugcaucacggggcacgacaagaacgccaccgccagcuucaucuacgacggccggcugguggacuccaucgggucguggucccagaacauccuccgcacccaggagucggagugcgugugcaucaacgggaccugcacggucgugaugaccgacggcuccgcgagcgggcgggccgacaccaagaucauguucguggaggagggcaagaucguccacaucucgccccuggccggguccgcccagcacguggaggagugcucgugcuacccgaaguaccccggcgugcgcugcgucugccgggacaacuggaagggcuccaaccgccccaucguggacaucaacaugaaggacuacagcaucguguccucguacgucugcuccgggcuggugggcgacacgccccggcgcaacgacagcuccucgaccuccuacugccucaacccgaacaacgaggagggcggccacggggugaagggcugggccuucgacgacggcgacgacgucuggauggggcggaccaucucggagaagcugcgccugggcuacgagaccuucaaggugaucgggggcugguccaagcccaacagcaagcuccagaucaaccggcaggucgugguggacaucuccaaccgcucgggguacuccggcaucuucucggucgagggcaaguccugcaucaaccggugcuucuacguggagcugauccgcgggcgcaagcaggagaacgaggugugguggaccagcaacucgaucgucguguucugcggcacguccgggaccuacggcaccgggagcuggcccgacggcgcggacaucaaccugaugcccaucuga

SEQ ID NO: 26220 - RNA, 1410 nt, Artificial Sequence
  derived and/or modified CDS sequence (AUadapt) from InfluenzaA__AGU69973__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucucgaaggacaacuccauccgccucagcgccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgaagcaggucugcaucgccugguccucguccagcugccacgacggcaaggcguggcugcacgugugcgugaccggggacgacgagaacgccaccgccuccuucaucuacaacggccgccugguggacucgaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgccccugucgggguccgcccagcacguggaggagugcagcugcuacccccgcuacccgggcgugcggugcgucugccgcgacaacuggaagggcuccaaccggcccaucguggacaucaacgugaaggacuacucgaucgucuccucguacgugcgcuccgggcucgugggcgacacgccccggaagaacgacagcuccucguccucgcacugccuggaccccaacaacgaggagggcgggcacggggucaagggcugggccuucgacgacggcaacgacguguggauggggcgcaccaucuccgagaagucccggagcggcuacgagaccuucaaggucaucgagggguggucgaagccgaacuccaagcugcagaucaaccgccaggugaucguggaccggggcaaccgcucgggguacuccggcaucuucagcgucgagggcaagucgugcaucaaccggugcuucuacguggagcucauccgcgggggcaagcaggagaccgaggugcuguggaccuccaacucgaucgucguguucugcgggaccuccggcaccuacgggacgggcagcuggcccgacggcgccgaccugaaccucaugcccaucuga

SEQ ID NO: 26221 - RNA, 1410 nt, Artificial Sequence
  derived and/or modified CDS sequence (AUadapt) from InfluenzaA__AGU92648__NA
augaaccccaaccagaagaucaucaccaucggcucggugugcaugaccaucgggauggccaaccugauccuccagaucggcaacaucaucuccaucuggaucagccacuccauccagcugcgcaaccagagccagaucgagacgugcaaccaguccgucaucaccuacgagaacaacaccugggugaaccagaccuacgugaacaucagcaacacgaacuucgccgcggggcaguccgucgugagcgugaagcuggccggcaacuccucgcucugcccggucuccgggugggccaucuacagcaaggacaacuccauccggaucggcagcaagggcgacguguucgugauccgcgagcccuucaucuccugcagcccccuggagugccggaccuucuuccugacccagggggcccuccugaacgacaagcacuccaacggcaccaucaaggaccgcagccccuaccggacgcugauguccugcccgaucggggagguccccagccccuacaacucgcgcuucgaguccguggccuggagcgcguccgccugccacgacggcaucaacuggcucaccaucgggaucagcggccccgacaacggcgccguggccguccugaaguacaacgggaucaucaccgacaccaucaaguccuggcggaacaacauccugcgcacgcaggagagcgagugcgcgugcgugaacggcuccugcuucaccaucaugaccgacgggccgagcgacggccaggccuccuacaagaucuuccggaucgagaagggcaagaucgucaagagcguggagaugaacgcccccaacuaccacuacgaggagugcuccugcuaccccgacucguccgagaucaucugcgugugccgcgacaacuggcacgggagcaaccggcccuggguguccuucaaccagaaccucgaguaccagaucggcuacaucugcagcgggaucuucggcgacaacccgcgccccaacgacaagaccggguccugcggccccgucagcuccaacggcgccaacggggugaagggcuucagcuucaaguacgggaacggcguguggaucgggcggaccaagagcaucuccucgcgcaagggcuucgagaugaucugggaccccaacggcuggacggggaccgacaacaacuucuccaucaagcaggacaucgucggcaucaacgaguggagcggguacuccggcagcuucgugcagcacccggagcugaccgggcuggacugcauccggcccugcuucuggguggagcucauccgcggccggcccaaggagaacacgaucuggaccuccggcagcuccaucagcuucugcggggucaacuccgacaccgugggcuggagcuggcccgacggggccgagcugccguucaccaucgacaaguga

SEQ ID NO: 26222 - RNA, 1410 nt, Artificial Sequence
  derived and/or modified CDS sequence (AUadapt) from InfluenzaA__AGU92670__NA
augaaccccaaccagaagaucaucaccaucggcucggugugcaugaccaucgggauggccaaccugauccuccagaucggcaacaucaucuccaucuggaucagccacuccauccagcugcgcaaccagagccagaucgagacgugcaaccaguccgucaucaccuacgagaacaacaccugggugaaccagaccuacgugaacaucagcaacacgaacuucgccgcggggcaguccgucgugagcgugaagcuggccggcaacuccucgcucugcccggucuccgggugggccaucuacagcaaggacaacuccauccggaucggcagcaagggcgacguguucgugauccgcgagcccuucaucuccugcagcccccuggagugccggaccuucuuccugacccagggggcccuccugaacgacaagcacuccaacggcaccaucaaggaccgcagccccuaccggacgcugauguccugcccgaucggggagguccccagccccuacaacucgcgcuucgaguccguggccuggagcgcguccgccugccacgacggcaucaacuggcucaccaucgggaucagcggccccgacaacggcgccguggccguccugaaguacaacgggaucaucaccgacaccaucaaguccuggcggaacaacauccugcgcacgcaggagagcgagugcgcgugcgugaacggcuccugcuucaccaucaugaccgacgggccgagcgacggccaggccuccuacaagaucuuccggaucgagaagggcaagaucgucaagagcguggagaugaacgcccccaacuaccacuacgaggagugcuccugcuaccccgacucguccgagaucaucugcgugugccgcgacaacuggcacgggagcaaccggcccuggguguccuucaaccagaaccucgaguaccagaucggcuacaucugcagcgggaucuucggcgacaacccgcgccccgacgacaagaccggguccugcggccccgucagcuccaacggcgccaacggggugaagggcuucagcuucaaguacgggaacggcguguggaucgggcggaccaagagcaucuccucgcgcaagggcuucgagaugaucugggaccccaacggcuggacggggaccgacaacaacuucuccaucaagcaggacaucgucggcaucaacgaguggagcggguacuccggcagcuucgugcagcacccggagcugaccgggcuggacugcauccggcccugcuucuggguggagcucauccgcggccggcccaaggagaacacgaucuggaccuccggcagcuccaucagcuucugcggggucaacuccgacaccgugggcuggagcuggcccgacggggccgagcugccguucaccaucgacaaguga

SEQ ID NO: 26223 - RNA, 1410 nt, Artificial Sequence
  derived and/or modified CDS sequence (AUadapt) from InfluenzaA__AGU92681__NA
augaaccccaaccagaagaucaucaccaucggcucggugugcaugaccaucgggauggccaaccugauccuccagaucggcaacaucaucuccaucuggaucagccacuccauccagcugcgcaaccagagccagaucgagacgugcaaccaguccgucaucaccuacgagaacaacaccugggugaaccagaccuacgugaacaucagcaacacgaacuucgccgcggggcaguccgucgugucggugaagcuggccggcaacuccagccucugcccggucuccgggugggccaccuacagcaaggacaacuccauccggaucggcagcaagggcgacguguucgugauccgcgagcccuucaucuccugcagcccccuggagugccggaccuucuuccugacccagggggcccuccugaacgacaagcacuccaacggcacgaucaaggaccgcucgcccuaccggacccugauguccugcccgaucggggagguccccagccccuacaacagccgcuucgaguccguggccuggagcgcguccgccugccacgacggcaucaacuggcucaccaucgggaucagcggccccgacaacggcgccguggccguccugaaguacaacgggaucaucaccgacacgaucaaguccuggcggaacaacauccugcgcacccaggagucggagugcgcgugcgugaacggcuccugcuucaccaucaugaccgacgggccgagcgacggccaggccuccuacaagaucuuccggaucgagaagggcaagaucgucaagagcguggagaugaacgcccccaacuaccacuacgaggagugcuccugcuaccccgacagcuccgagaucaucugcgugugccgcgacaacuggcacgggagcaaccggcccuggguguccuucaaccagaaccucgaguaccagaucggcuacaucugcucggggaucuucggcgacaacccgcgccccaacgacaagacgggguccugcggccccgucagcuccaacggcgccaacggggugaagggcuucagcuucaaguacgggaacggcguguggaucgggcggaccaagagcaucuccagccgcaagggcuucgagaugaucugggaccccaacggcuggaccgggaccgacaacaacuucuccaucaagcaggacaucgucggcaucaacgaguggucgggguacuccggcagcuucgugcagcacccggagcugacggggcuggacugcauccggcccugcuucuggguggagcucauccgcggccggcccaaggagaacaccaucuggaccuccggcagcuccaucagcuucugcggggucaacuccgacaccgugggcuggagcuggcccgacggggccgagcugccguucacgaucgacaaguga

SEQ ID NO: 26224 - RNA, 1410 nt, Artificial Sequence; identical to SEQ ID NO: 16286
  derived and/or modified CDS sequence (AUadapt) from InfluenzaA__AGU92692__NA

SEQ ID NO: 26225 - RNA, 1410 nt, Artificial Sequence; identical to SEQ ID NO: 16286
  derived and/or modified CDS sequence (AUadapt) from InfluenzaA__AGU92703__NA

SEQ ID NO: 26226 - RNA, 1410 nt, Artificial Sequence; identical to SEQ ID NO: 16286
  derived and/or modified CDS sequence (AUadapt) from InfluenzaA__AGU92714__NA

SEQ ID NO: 26227 - RNA, 1410 nt, Artificial Sequence; identical to SEQ ID NO: 16286
  derived and/or modified CDS sequence (AUadapt) from InfluenzaA__AGU92725__NA

SEQ ID NO: 26228 - RNA, 1410 nt, Artificial Sequence; identical to SEQ ID NO: 16286
  derived and/or modified CDS sequence (AUadapt) from InfluenzaA__AGU92736__NA

SEQ ID NO: 26229 - RNA, 1410 nt, Artificial Sequence; identical to SEQ ID NO: 16286
  derived and/or modified CDS sequence (AUadapt) from InfluenzaA__AGU92747__NA

SEQ ID NO: 26230 - RNA, 1410 nt, Artificial Sequence; identical to SEQ ID NO: 16286
  derived and/or modified CDS sequence (AUadapt) from InfluenzaA__AGU92758__NA

SEQ ID NO: 26231 - RNA, 1410 nt, Artificial Sequence; identical to SEQ ID NO: 26221
  derived and/or modified CDS sequence (AUadapt) from InfluenzaA__AGU92769__NA

SEQ ID NO: 26232 - RNA, 1410 nt, Artificial Sequence; identical to SEQ ID NO: 26221
  derived and/or modified CDS sequence (AUadapt) from InfluenzaA__AGU92780__NA

SEQ ID NO: 26233 - RNA, 1410 nt, Artificial Sequence
  derived and/or modified CDS sequence (AUadapt) from InfluenzaA__AGU92791__NA
augaaccccaaccagaagaucaucaccaucggcucggugugcaugaccaucgggauggccaaccugauccuccagaucggcaacaucaucuccaucuggaucagccacuccauccagcugcgcaaccagagccagaucgagacgugcaaccaguccgucaucaccuacgagaacaacaccugggugaaccagaccuacgugaacaucagcaacacgaacuucgccgcggggcaguccgucgugagcgugaagcuggccggcaacuccagccucugcccggucuccgggugggccaucuacagcaaggacaacuccauccggaucggcucgaagggcgacguguucgugauccgcgagcccuucaucuccugcagcccccuggagugccggaucuucuuccugacccagggggcccuccugaacgacaagcacuccaacggcaccaucaaggaccgcagccccuaccggacccugauguccugcccgaucggggagguccccagccccuacaacagccgcuucgaguccguggccuggagcgcguccgccugccacgacggcaucaacuggcucacgaucgggaucagcggccccgacaacggcgccguggccguccugaaguacaacgggaucaucaccgacaccaucaaguccuggcggaacaacauccugcgcacccaggagucggagugcgcgugcgugaacggcuccugcuucacgaucaugaccgacgggccgagcgacggccaggccuccuacaagaucuuccggaucgagaagggcaagaucgucaagagcguggagaugaacgcccccaacuaccacuacgaggagugcuccugcuaccccgacagcuccgagaucaucugcgugugccgcgacaacuggcacgggagcaaccggcccuggguguccuucaaccagaaccucgaguaccagaucggcuacaucugcagcgggaucuucggcgacaacccgcgccccaacgacaagaccggguccugcggccccgucagcuccaacggcgccaacggggugaagggcuucucguucaaguacgggaacggcguguggaucgggcggaccaagagcaucuccagccgcaagggcuucgagaugaucugggaccccaacggcuggacggggaccgacaacaacuucuccaucaagcaggacaucgucggcaucaacgaguggagcggguacuccggcagcuucgugcagcacccggagcugaccgggcuggacugcauccggcccugcuucuggguggagcucauccgcggccggcccaaggagaacaccaucuggacguccggcagcuccaucagcuucugcggggucaacuccgacaccgugggcuggagcuggcccgacggggccgagcugccguucaccaucgacaaguga

SEQ ID NO: 26234 - RNA, 1410 nt, Artificial Sequence; identical to SEQ ID NO: 26221
  derived and/or modified CDS sequence (AUadapt) from InfluenzaA__AGU92802__NA

SEQ ID NO: 26235 - RNA, 1410 nt, Artificial Sequence; identical to SEQ ID NO: 26221
  derived and/or modified CDS sequence (AUadapt) from InfluenzaA__AGU92813__NA

SEQ ID NO: 26236 - RNA, 1410 nt, Artificial Sequence; identical to SEQ ID NO: 26221
  derived and/or modified CDS sequence (AUadapt) from InfluenzaA__AGU92824__NA

SEQ ID NO: 26237 - RNA, 1410 nt, Artificial Sequence; identical to SEQ ID NO: 16284
  derived and/or modified CDS sequence (AUadapt) from InfluenzaA__AGU92846__NA

SEQ ID NO: 26238 - RNA, 1410 nt, Artificial Sequence; identical to SEQ ID NO: 16283
  derived and/or modified CDS sequence (AUadapt) from InfluenzaA__AGU92868__NA

SEQ ID NO: 26239 - RNA, 1410 nt, Artificial Sequence; identical to SEQ ID NO: 16282
  derived and/or modified CDS sequence (AUadapt) from InfluenzaA__AGU92890__NA

SEQ ID NO: 26240 - RNA, 1410 nt, Artificial Sequence; identical to SEQ ID NO: 26221
  derived and/or modified CDS sequence (AUadapt) from InfluenzaA__AGU92901__NA

SEQ ID NO: 26241 - RNA, 1410 nt, Artificial Sequence; identical to SEQ ID NO: 26221
  derived and/or modified CDS sequence (AUadapt) from InfluenzaA__AGU92912__NA

SEQ ID NO: 26242 - RNA, 1410 nt, Artificial Sequence; identical to SEQ ID NO: 26221
  derived and/or modified CDS sequence (AUadapt) from InfluenzaA__AGU92923__NA

SEQ ID NO: 26243 - RNA, 1410 nt, Artificial Sequence; identical to SEQ ID NO: 16286
  derived and/or modified CDS sequence (AUadapt) from InfluenzaA__AGU92934__NA

SEQ ID NO: 26244 - RNA, 1410 nt, Artificial Sequence; identical to SEQ ID NO: 16286
  derived and/or modified CDS sequence (AUadapt) from InfluenzaA__AGU92945__NA

SEQ ID NO: 26245 - RNA, 1410 nt, Artificial Sequence; identical to SEQ ID NO: 16286
  derived and/or modified CDS sequence (AUadapt) from InfluenzaA__AGU92956__NA

SEQ ID NO: 26246 - RNA, 1410 nt, Artificial Sequence; identical to SEQ ID NO: 26221
  derived and/or modified CDS sequence (AUadapt) from InfluenzaA__AGU92967__NA

SEQ ID NO: 26247 - RNA, 1410 nt, Artificial Sequence; identical to SEQ ID NO: 26221
  derived and/or modified CDS sequence (AUadapt) from InfluenzaA__AGU92978__NA

SEQ ID NO: 26248 - RNA, 1410 nt, Artificial Sequence; identical to SEQ ID NO: 16285
  derived and/or modified CDS sequence (AUadapt) from InfluenzaA__AGU92989__NA

SEQ ID NO: 26249 - RNA, 1410 nt, Artificial Sequence; identical to SEQ ID NO: 16283
  derived and/or modified CDS sequence (AUadapt) from InfluenzaA__AGU93000__NA

SEQ ID NO: 26250 - RNA, 1410 nt, Artificial Sequence; identical to SEQ ID NO: 16282
  derived and/or modified CDS sequence (AUadapt) from InfluenzaA__AGU93011__NA

SEQ ID NO: 26251 - RNA, 1365 nt, Artificial Sequence; identical to SEQ ID NO: 22792
  derived and/or modified CDS sequence (AUadapt) from InfluenzaA__AGU93022__NA

SEQ ID NO: 26252 - RNA, 1410 nt, Artificial Sequence
  derived and/or modified CDS sequence (AUadapt) from InfluenzaA__AGU93034__NA
augaaccccacccagaagaucaucaccaucggcucggugugcaugacgaucgggauggccaaccugauccuccagaucggcaacaucaucuccaucuggaucagccacuccauccagcuggggaaccagaaccagaucgagaccugcaaccagagcgucaucaccuacgagaacaacaccugggugaaccagacguacgugaacaucuccaacaccaacuucgccgcgggccagagcgucgccuccgugaagcuggccgggaacucgucccucugcccggugagcggcugggccaucuacuccaaggacaacagcauccgcaucggcuccaagggggacgucuucgugauccgggagcccuucaucagcugcucgccccuggagugccgcaccuucuuccugacccagggcgcccuccugaacgacaagcacuccaacgggacgaucaaggaccggucccccuaccgcacccugaugagcugcccgaucggcgaggugcccucccccuacaacagccgguucgagagcgucgcgugguccgccucggccugccacgacgggaucaacuggcucaccaucggcaucuccggccccgacaacggggccguggcggugcugaaguacaacggcaucaucaccgacacgaucaagagcuggcgcaacaacauccugcggacccaggaguccgagugcgccugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccucgaacggggccaacggcgucaagggguucuccuucaaguacggcaacgggguguggaucggccgcaccaagagcaucagcucccggaagggcuucgagaugaucugggaccccaacggguggaccggcacggacaacaacuucagcaucaagcaggacaucguggggaucaacgagugguccggcuacucgggguccuucguccagcacccggagcugaccggccuggacugcauccgccccugcuucuggguggagcucauccggggccgccccaaggagaacaccaucuggaccagcggguccagcaucuccuucugcggcgugaacagcgacacggucgggugguccuggcccgacggcgcggagcugccguucaccaucgacaaguga

SEQ ID NO: 26253 - RNA, 1410 nt, Artificial Sequence; identical to SEQ ID NO: 25560
  derived and/or modified CDS sequence (AUadapt) from InfluenzaA__AGU93045__NA

SEQ ID NO: 26254 - RNA, 1410 nt, Artificial Sequence; identical to SEQ ID NO: 26221
  derived and/or modified CDS sequence (AUadapt) from InfluenzaA__AGU93056__NA

SEQ ID NO: 26255 - RNA, 1410 nt, Artificial Sequence; identical to SEQ ID NO: 16339
  derived and/or modified CDS sequence (AUadapt) from InfluenzaA__AGV98980__NA

SEQ ID NO: 26256 - RNA, 1410 nt, Artificial Sequence; identical to SEQ ID NO: 16339
  derived and/or modified CDS sequence (AUadapt) from InfluenzaA__AGV98993__NA

SEQ ID NO: 26257 - RNA, 1410 nt, Artificial Sequence; identical to SEQ ID NO: 16339
  derived and/or modified CDS sequence (AUadapt) from InfluenzaA__AGV99005__NA

SEQ ID NO: 26258 - RNA, 1410 nt, Artificial Sequence; identical to SEQ ID NO: 16339
  derived and/or modified CDS sequence (AUadapt) from InfluenzaA__AGV99017__NA

SEQ ID NO: 26259 - RNA, 1410 nt, Artificial Sequence; identical to SEQ ID NO: 16339
  derived and/or modified CDS sequence (AUadapt) from InfluenzaA__AGV99040__NA

SEQ ID NO: 26260 - RNA, 1410 nt, Artificial Sequence
  derived and/or modified CDS sequence (AUadapt) from InfluenzaA__AGV99052__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccgucaucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 26261 - RNA, 1410 nt, Artificial Sequence
  derived and/or modified CDS sequence (AUadapt) from InfluenzaA__AGV99100__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcgugaaccggugcuucuacguggagcugauccgcggccggaaggaggagaccgagguccucuggaccucgaacuccaucgugguguucugcgggacgagcggcaccuacgggaccggcuccuggcccgacggggccgaccugaaccugaugcccaucuga

SEQ ID NO: 26262 - RNA, 1410 nt, Artificial Sequence; identical to SEQ ID NO: 16339
  derived and/or modified CDS sequence (AUadapt) from InfluenzaA__AGV99112__NA

SEQ ID NO: 26263 - RNA, 1410 nt, Artificial Sequence; identical to SEQ ID NO: 16339
  derived and/or modified CDS sequence (AUadapt) from InfluenzaA__AGV99124__NA

SEQ ID NO: 26264 - RNA, 1410 nt, Artificial Sequence; identical to SEQ ID NO: 16339
  derived and/or modified CDS sequence (AUadapt) from InfluenzaA__AGV99136__NA

SEQ ID NO: 26265 - RNA, 1410 nt, Artificial Sequence; identical to SEQ ID NO: 16339
  derived and/or modified CDS sequence (AUadapt) from InfluenzaA__AGV99148__NA

SEQ ID NO: 26266 - RNA, 1410 nt, Artificial Sequence; identical to SEQ ID NO: 16339
  derived and/or modified CDS sequence (AUadapt) from InfluenzaA__AGV99160__NA

SEQ ID NO: 26267 - RNA, 1410 nt, Artificial Sequence; identical to SEQ ID NO: 16339
  derived and/or modified CDS sequence (AUadapt) from InfluenzaA__AGV99172__NA

SEQ ID NO: 26268 - RNA, 1410 nt, Artificial Sequence; identical to SEQ ID NO: 16339
  derived and/or modified CDS sequence (AUadapt) from InfluenzaA__AGV99196__NA

SEQ ID NO: 26269 - RNA, 1410 nt, Artificial Sequence; identical to SEQ ID NO: 16339
  derived and/or modified CDS sequence (AUadapt) from InfluenzaA__AGV99208__NA

SEQ ID NO: 26270 - RNA, 1410 nt, Artificial Sequence; identical to SEQ ID NO: 16339
  derived and/or modified CDS sequence (AUadapt) from InfluenzaA__AGV99959__NA

SEQ ID NO: 26271 - RNA, 1410 nt, Artificial Sequence; identical to SEQ ID NO: 25759
  derived and/or modified CDS sequence (AUadapt) from InfluenzaA__AGW00005__NA

SEQ ID NO: 26272 - RNA, 1410 nt, Artificial Sequence; identical to SEQ ID NO: 16339
  derived and/or modified CDS sequence (AUadapt) from InfluenzaA__AGW00068__NA

SEQ ID NO: 26273 - RNA, 1410 nt, Artificial Sequence; identical to SEQ ID NO: 16359
  derived and/or modified CDS sequence (AUadapt) from InfluenzaA__AGW00080__NA

SEQ ID NO: 26274 - RNA, 1410 nt, Artificial Sequence
  derived and/or modified CDS sequence (AUadapt) from InfluenzaA__AGW00104__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcgaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 26275 - RNA, 1410 nt, Artificial Sequence; identical to SEQ ID NO: 16359
  derived and/or modified CDS sequence (AUadapt) from InfluenzaA__AGW00116__NA

SEQ ID NO: 26276 - RNA, 1410 nt, Artificial Sequence; identical to SEQ ID NO: 16359
  derived and/or modified CDS sequence (AUadapt) from InfluenzaA__AGW00128__NA

SEQ ID NO: 26277 - RNA, 1410 nt, Artificial Sequence; identical to SEQ ID NO: 16339
  derived and/or modified CDS sequence (AUadapt) from InfluenzaA__AGW00140__NA

SEQ ID NO: 26278 - RNA, 1410 nt, Artificial Sequence; identical to SEQ ID NO: 16339
  derived and/or modified CDS sequence (AUadapt) from InfluenzaA__AGW00152__NA

SEQ ID NO: 26279 - RNA, 1410 nt, Artificial Sequence; identical to SEQ ID NO: 16359
  derived and/or modified CDS sequence (AUadapt) from InfluenzaA__AGW00164__NA

SEQ ID NO: 26280 - RNA, 1410 nt, Artificial Sequence; identical to SEQ ID NO: 16339
  derived and/or modified CDS sequence (AUadapt) from InfluenzaA__AGW00176__NA

SEQ ID NO: 26281 - RNA, 1410 nt, Artificial Sequence; identical to SEQ ID NO: 16339
  derived and/or modified CDS sequence (AUadapt) from InfluenzaA__AGW00188__NA

SEQ ID NO: 26282 - RNA, 1410 nt, Artificial Sequence; identical to SEQ ID NO: 16339
  derived and/or modified CDS sequence (AUadapt) from InfluenzaA__AGW00712__NA

SEQ ID NO: 26283 - RNA, 1410 nt, Artificial Sequence; identical to SEQ ID NO: 16339
  derived and/or modified CDS sequence (AUadapt) from InfluenzaA__AGW00724__NA

SEQ ID NO: 26284 - RNA, 1410 nt, Artificial Sequence
  derived and/or modified CDS sequence (AUadapt) from InfluenzaA__AGW00736__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccagaugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggugacccgggagcccuacgucagcugcgacccggacaagugcuaccaguucgcccuggggcagggcaccacgcucaacaacgugcacuccaacaacaccgugcgcgaccggacccccuaccgcacccugcugaugaacgagcucggcguccccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggugagcugguccaaggagauccugcgcacccaggagucggagugcgucugcaucaacgggacgugcaccguggugaugaccgacggcuccgccagcggcaaggccgacaccaagauccuguucaucgaggaggggaagaucguccacacgucgacccucuccggcucggcgcagcacguggaggagugcuccugcuacccccgguacccgggggugcgcugcgucugccgggacaacuggaagggcagcaaccgccccaucguggacaucaacaucaaggaccacuccaucgugucguccuacgucugcagcggccuggugggggacaccccgcggaagaacgacuccucguccagcucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccgaccccaagagcaagcugcagaucaaccgccaggucaucguggaccgcggggaccgguccggcuacucggggaucuucuccguggagggcaagagcugcaucaaccggugcuucuacgucgagcugauccgcggccggaaggaggagaccgaggugcucuggaccucgaacuccaucguggucuucugcgggacgagcggcaccuacgggaccggcuccuggcccgacggggccgaccugaaccugaugcccaucuga

SEQ ID NO: 26285 - RNA, 1410 nt, Artificial Sequence
  derived and/or modified CDS sequence (AUadapt) from InfluenzaA__AGW00748__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacaugcacuccaacaacaccgugcgcgaccggacccccuaccgcacccugcugaugaacgagcucggcguccccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggugagcugguccaaggagauccugcgcacccaggagucggagugcgucugcaucaacgggacgugcaccguggugaugaccgacggcuccgccagcggcaaggccgacaccaagauccuguucaucgaggaggggaagaucguccacacgucgacccucuccggcucggcgcagcacguggaggagugcuccugcuacccccgguacccgggggugcgcugcgucugccgggacaacuggaagggcagcaaccgccccaucguggacaucaacaucaaggaccacuccaucgugucguccuacgucugcagcggccuggugggggacaccccgcggaagaacgacuccucguccagcucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggucaucguggaccgcggggaccgguccggcuacucggggaucuucuccguggagggcaagagcugcaucaaccggugcuucuacgucgagcugauccgcggccggaaggaggagaccgaggugcucuggaccucgaacuccaucguggucuucugcgggacgagcggcaccuacgggaccggcuccuggcccgacggggccgaccugaaccugaugcccaucuga

SEQ ID NO: 26286 - RNA, 1410 nt, Artificial Sequence
  derived and/or modified CDS sequence (AUadapt) from InfluenzaA__AGW00760__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcuccaggugaaccgccaggugaucgucgaccgcggggaccgguccggcuacucggggaucuucuccguggagggcaagagcugcaucaaccggugcuucuacguggagcugauccgcggccggaaggaggagaccgagguccuguggaccucgaacuccaucgugguguucugcgggacgagcggcaccuacgggaccggcuccuggcccgacggggccgaccugaaccugaugcccaucuga

SEQ ID NO: 26287 - RNA, 1410 nt, Artificial Sequence; identical to SEQ ID NO: 16339
  derived and/or modified CDS sequence (AUadapt) from InfluenzaA__AGW00784__NA

SEQ ID NO: 26288 - RNA, 1410 nt, Artificial Sequence; identical to SEQ ID NO: 16339
  derived and/or modified CDS sequence (AUadapt) from InfluenzaA__AGW00796__NA

SEQ ID NO: 26289 - RNA, 1410 nt, Artificial Sequence; identical to SEQ ID NO: 16359
  derived and/or modified CDS sequence (AUadapt) from InfluenzaA__AGW00808__NA

SEQ ID NO: 26290 - RNA, 1410 nt, Artificial Sequence; identical to SEQ ID NO: 25777
  derived and/or modified CDS sequence (AUadapt) from InfluenzaA__AGW00820__NA

SEQ ID NO: 26291 - RNA, 1410 nt, Artificial Sequence; identical to SEQ ID NO: 16339
  derived and/or modified CDS sequence (AUadapt) from InfluenzaA__AGW00832__NA

SEQ ID NO: 26292 - RNA, 1410 nt, Artificial Sequence
  derived and/or modified CDS sequence (AUadapt) from InfluenzaA__AGW00844__NA
augaaccccaaccagaagaucaucaccaucggcucggugucccugaccaucagcacgaucugcuucuucaugcagaucgccauccucaucaccaccgucacccugcacuucaagcaguacgaguucaacuucccgcccaacaaccaggugaugcugugcgagcccacgaucaucgagcgcaacaucaccgagaucguguaccucaccaacaccacgaucgagaaggagaucugccccaagccggccgaguaccggaacugguccaagccccagugcgggaucaccggcuucgcgcccuucucgaaggacaacuccauccgccugagcgccgggggcgacaucugggucacccgggagcccuacguguccugcgacccggacaagugcuaccaguucgcccuggggcagggcaccacgcucaacaacgugcacucgaacaacaccguccgcgaccggacccccuaccgcacccugcugaugaacgagcucggcgugcccuuccaccuggggacgaagcaggucugcaucgccugguccagcuccucgugccacgacggcaaggccuggcugcacgugugcaucaccggggacgacaagaacgcgaccgccuccuucaucuacaacggccggcucguggacagcguggucuccuggucgaaggagauccugcgcacccaggaguccgagugcgugugcaucaacgggacgugcaccguggucaugaccgacggcagcgccuccggcaaggccgacaccaagauccuguucaucgaggaggggaagaucgugcacacgucgacccucagcggcuccgcgcagcacguggaggagugcucgugcuacccccgguacccggggguccgcugcgugugccgggacaacuggaagggcuccaaccgccccaucguggacaucaacaucaaggaccacagcaucgucuccucguacgugugcuccggccuggugggggacacgccccggaagaacgacagcuccucguccagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggucgaacccgaaguccaagcugcagaucaaccgccaggugaucguggaccgcggggaccggagcggcuacuccgggaucuucucggucgagggcaaguccugcaucaaccggugcuucuacguggagcugauccgcggccggaaggaggagaccgaggugcucuggaccagcaacucgaucgucguguucugcgggacguccggcaccuacgggaccggcagcuggcccgacggggccgaccugaaccugaugcccaucuga

SEQ ID NO: 26293 - RNA, 1410 nt, Artificial Sequence; identical to SEQ ID NO: 26285
  derived and/or modified CDS sequence (AUadapt) from InfluenzaA__AGW00868__NA

SEQ ID NO: 26294 - RNA, 1410 nt, Artificial Sequence
  derived and/or modified CDS sequence (AUadapt) from InfluenzaA__AGW00880__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacgucugggugacccgggagcccuacgugagcugcgacccggacaagugcuaccaguucgcccugggccaggggaccacgcucaacaacguccacuccaacaacaccgugcgcgaccggacccccuaccgcacccugcugaugaacgagcucggcgugcccuuccaccugggcacgaagcaggucugcaucgccuggucguccucguccugccacgacgggaaggccuggcugcacgugugcaucaccggcgacgacaagaacgcgaccgccagcuucaucuacaacgggaagcucguggacuccgucgugucgugguccaaggagauccugcggacccaggagagcgagugcgugugcaucaacggcacgugcaccgucgugaugaccgacggguccgccucgggcaaggccgacaccaagauccuguucaucgaggagggcaagaucgugcacacgagcacccucuccgggucggcgcagcacgucgaggagugcuccugcuacccccgcuacccggacgugcggugcgugugccgcgacaacuggaagggcucgaaccggcccaucgucgacaucaacaucaaggaccacuccaucgugagccgcuacgugugcuccgggcuggucggcgacacgccccggaagaacgacucguccagcuccucgcacugccuggaccccaacaacgaggagggcgggcacggcgugaaggggugggccuucgacgacggcaacgacgucuggauggggcgcaccaucaacgagaccucccggcucggcuacgagaccuucaaggugaucgagggcuggucgaacccgaaguccaagcugcagaucaaccgccaggugaucgucgaccgcggggaccggagcggcuacuccgggaucuucucgguggagggcaaguccugcaucaaccggugcuucuacguggagcugauccgcgggcggaaggaggagaccgagguccucuggaccagcaacucgaucgugguguucugcggcacguccggcaccuacgggaccggcagcuggcccgacggggccgaccugaaccugaugcccaucuga

SEQ ID NO: 26295 - RNA, 1410 nt, Artificial Sequence
  derived and/or modified CDS sequence (AUadapt) from InfluenzaA__AGW00892__NA
augaaccccaaccagaagaucaucaccaucggcucggugucccugaccaucucgacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcccgccgaguaccggaacugguccaagccccagugcgggaucaccggcuucgcgcccuucagcaaggacaacuccauccgccugucggccgggggcgacaucugggucacccgggagccguacguguccugcgaccccgacaagugcuaccaguucgcccuggggcagggcaccacgcucaacaacgugcacagcaacaacaccguccgcgaccggacccccuaccgcacccugcugaugaacgagcucggcgugcccuuccaccuggggacgaagcaggucugcaucgccugguccucguccucgugccacgacggcaaggccuggcugcacgugugcaucaccggggacgacaagaacgcgaccgccuccuucaucuacaacggccggcucguggacagcguggucuccuggucgaaggagauccugcgcacccaggaguccgagugcgugugcaucaacgggacgugcaccguggucaugaccgacggcagcgccuccggcaaggccgacaccaagauccuguucaucgaggaggggaagaucgugcacacgucgacccucagcggcuccgcgcagcacguggaggagugcucgugcuacccgcgguaccccgggguccgcugcgugugccgggacaacuggaagggcuccaaccgccccaucguggacaucaacaucaaggaccacucgaucgucuccagcuacgugugcuccggccuggugggggacacgccccggaagaacgacucguccagcuccucgcacugccuggacccgaacaacgaggagggcgggcacggcgucaaggggugggccuucgacgacggcaacgacguguggaugggccgcaccaucaacgagaccucccggcucggguacgagaccuucaaggucaucgagggcuggucgaaccccaaguccaagcugcagaugaaccgccaggugaucguggaccgcggggaccggagcggcuacuccgggaucuucucggucgagggcaaguccugcaucaaccggugcuucuacguggagcugauccgcggccggaaggaggagaccgaggugcucuggaccagcaacucgaucgucguguucugcgggacguccggcaccuacgggaccggcagcuggcccgacggggccgaccugaaccugaugcccaucuga

SEQ ID NO: 26296 - RNA, 1410 nt, Artificial Sequence
  derived and/or modified CDS sequence (AUadapt) from InfluenzaA__AGW00904__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgggccggacaagugcuaccaguucgcccugggccagggcaccacgcucaacaacaugcacuccaacaacaccgugcgcgaccggacccccuaccgcacccugcugaugaacgagcucgggguccccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggugagcugguccaaggagauccugcgcacccaggagucggagugcgucugcaucaacggcacgugcaccguggugaugaccgacggcuccgccagcgggaaggccgacaccaagauccuguucaucgaggagggcaagaucguccacacgucgacccucuccgggucggcgcagcacguggaggagugcuccugcuacccccgguacccgggcgugcgcugcgucugccgggacaacuggaagggcagcaaccgccccaucguggacaucaacaucaaggaccacuccaucgugucguccuacgucugcagcgggcuggugggcgacaccccgcggaagaacgacuccucguccagcucccacugccuggaccccaacaacgaggagggcgggcacggggugaagggcugggccuucgacgacggcaacgacgucuggauggggcgcaccaucaacgagacgucgcggcucggcuacgagaccuucaaggugaucgaggggugguccaaccccaagagcaagcugcagaucaaccgccaggucaucguggaccggggcgaccgcuccggguacucgggcaucuucuccguggagggcaagagcugcaucaaccggugcuucuacgucgagcugauccgcgggcggaaggaggagaccgaggugcucuggaccucgaacuccaucguggucuucugcggcacgagcgggaccuacggcaccggguccuggcccgacggcgccgaccugaaccugaugcccaucuga

SEQ ID NO: 26297 - RNA, 1410 nt, Artificial Sequence
  derived and/or modified CDS sequence (AUadapt) from InfluenzaA__AGW00916__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggucgaagccccagugcgggaucaccggcuucgcgcccuucuccaaggacaacagcauccgccuguccgccgggggcgacaucugggucacccgggagcccuacgugucgugcgacccggacaagugcuaccaguucgcccuggggcagggcaccacgcucaacaacaugcacuccaacaacaccgugugcgaccgcacccccuaccggacccugcugaugaacgagcucggcguccccuuccaccuggggacgaagcaggucugcaucgccuggagcuccucguccugccacgacggcaaggccuggcugcacgugugcaucaccggggacgacaagaacgcgaccgccagcuucaucuacaacggccgccucguggacuccguggugucgugguccaaggagauccugcggacccaggagagcgagugcgucugcaucaacgggacgugcaccguggugaugaccgacggcuccgccucgggcaaggccgacaccaagauccuguucaucgaggaggggaagaucguccacacgagcacccucuccggcucggcgcagcacguggaggagugcuccugcuacccccgcuacccgggggugcggugcgucugccgcgacaacuggaagggcagcaaccggcccaucguggacaucaacaucaaggaccacuccaucgugucguccuacgucugcagcggccuggugggggacaccccgcgcaagaacgacuccucguccagcucccacugccuggaccccaacaacgaggagggcgggcacggcgugaaggggugggccuucgacgacggcaacgacgucuggaugggccggaccaucaacgagacgucgcgccucggguacgagaccuucaaggugaucgagggcugguccaaccccaagagcaagcugcagaucaaccggcaggucaucguggaccgcggggaccgguccggcuacucggggaucuucuccguggagggcaagagcugcaucaaccgcugcuucuacgucgagcugauccggggccgcaaggaggagaccgaggugcucuggaccucgaacuccaucguggucuucugcgggacgagcggcaccuacgggaccggcuccuggcccgacggggccgaccugaaccugaugcccaucuga

SEQ ID NO: 26298 - RNA, 1410 nt, Artificial Sequence; identical to SEQ ID NO: 16359
  derived and/or modified CDS sequence (AUadapt) from InfluenzaA__AGW00934__NA

SEQ ID NO: 26299 - RNA, 1410 nt, Artificial Sequence
  derived and/or modified CDS sequence (AUadapt) from InfluenzaA__AGW01247__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaaggacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 26300 - RNA, 1410 nt, Artificial Sequence; identical to SEQ ID NO: 16339
  derived and/or modified CDS sequence (AUadapt) from InfluenzaA__AGW01259__NA

SEQ ID NO: 26301 - RNA, 1410 nt, Artificial Sequence; identical to SEQ ID NO: 26285
  derived and/or modified CDS sequence (AUadapt) from InfluenzaA__AGW01298__NA

SEQ ID NO: 26302 - RNA, 1410 nt, Artificial Sequence; identical to SEQ ID NO: 25777
  derived and/or modified CDS sequence (AUadapt) from InfluenzaA__AGW01322__NA

SEQ ID NO: 26303 - RNA, 1410 nt, Artificial Sequence
  derived and/or modified CDS sequence (AUadapt) from InfluenzaA__AGW01334__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggaggccgaggugcucuggaccucgaacuccaucgucguguucugcgggaccagcggcacguacgggaccggcuccuggcccgacggggccgaccugaaccugaugcccaucuga

SEQ ID NO: 26304 - RNA, 1410 nt, Artificial Sequence; identical to SEQ ID NO: 16339
  derived and/or modified CDS sequence (AUadapt) from InfluenzaA__AGW01346__NA

SEQ ID NO: 26305 - RNA, 1410 nt, Artificial Sequence
  derived and/or modified CDS sequence (AUadapt) from InfluenzaA__AGW01358__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccgaccgaguaccggaacuggagcaagccccagugcgggaucaccggcuucgcccccuucuccaaggacaacucgauccgccuguccgccgggggcgacaucugggucacccgggagcccuacgugagcugcgacccggacaagugcuaccaguucgcgcuggggcagggcacgacccucaacaacgugcacuccaacaacaccguccgcgaccggacccccuaccgcacgcugcugaugaacgagcucggcgugcccuuccaccuggggaccaagcaggucugcaucgccuggucguccagcuccugccacgacggcaaggccuggcugcacgugugcaucaccggggacgacaagaacgccaccgcgucguucaucuacaacggccggcucguggacuccguggucagcugguccaaggagauccugcgcacgcaggagucggagugcgugugcaucaacgggaccugcaccguggucaugaccgacggcuccgccagcggcaaggccgacacgaagauccuguucaucgaggaggggaagaucgugcacaccucgacccucuccggcucggcccagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggcguucgacgacggcaacgacguguggaugggccgcacgaucaacgagaccucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggacgucgaacuccaucgucguguucugcgggaccagcggcaccuacgggaccggcuccuggcccgacggggccgaccugaaccugaugcccaucuga

SEQ ID NO: 26306 - RNA, 1410 nt, Artificial Sequence; identical to SEQ ID NO: 16339
  derived and/or modified CDS sequence (AUadapt) from InfluenzaA__AGW01370__NA

SEQ ID NO: 26307 - RNA, 1410 nt, Artificial Sequence; identical to SEQ ID NO: 16339
  derived and/or modified CDS sequence (AUadapt) from InfluenzaA__AGW01382__NA

SEQ ID NO: 26308 - RNA, 1410 nt, Artificial Sequence
  derived and/or modified CDS sequence (AUadapt) from InfluenzaA__AGW01394__NA
augaaccccaaccagaagaucaucaccaucggcucggugucccugaccaucucgacgaucugcuucuucaugcagaucgccauccucaucaccaccgucacccugcacuucaagcaguacgaguucgacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccaucgugagcugguccaaggacauccugcgcacccaggagucggagugcgucugcaucaacgggacgugcaccguggugaugaccgacggcuccgccagcggcaaggccgacaccaagauccuguucaucgaggaggggaagaucguccacacgucgacccucuccggcucggcgcagcacguggaggagugcuccugcuacccccgguacccgggggugcgcugcgucugccgggacaacuggaagggcagcaaccgccccaucguggacaucaacaucaaggaccacuccaucgugucguccuacgucugcagcggccuggugggggacaccccgcggaagaacgacuccucguccagcucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggucaucguggaccgcggggaccgguccggcuacucggggaucuucuccguggagggcaagagcugcaucaaccggugcuucuacgucgagcugauccgcggccggaaggaggagaccgaggugcucuggaccucgaacuccaucguggucuucugcgggacgagcggcaccuacgggaccggcuccuggcccgacggggccgaccugaaccugaugcccaucuga

SEQ ID NO: 26309 - RNA, 1410 nt, Artificial Sequence
  derived and/or modified CDS sequence (AUadapt) from InfluenzaA__AGW01406__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacaugcacuccaacaacaccgugcgcgaccggacccccuaccgcacccugcugaugaacgagcucggcguccccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggugagcugguccaaggagauccugcgcacccaggagucggagugcgucugcaucaacggcacgugcaccguggugaucaccgacggguccgccagcggcaaggccgacaccaagauccuguucaucgaggagggcaagaucguccacacgucgacccucuccgggucggcgcagcacguggaggagugcuccugcuacccccgguacccgggcgugcgcugcgucugccgggacaacuggaaggggagcaaccgccccaucguggacaucaacaucaaggaccacuccaucgugucguccuacgucugcagcggccuggugggcgacaccccgcggaagaacgacuccucguccagcucccacugccuggaccccaacaacgaggagggcgggcacggggugaagggcugggccuucgacgacgggaacgacgucuggaugggccgcaccaucaacgagacgucgcggcucggcuacgagaccuucaaggugaucgaggggugguccaaccccaagagcaagcugcagaucaaccgccaggucaucguggaccggggcgaccgcuccggguacucgggcaucuucuccguggagggcaagagcugcaucaaccggugcuucuacgucgagcugauccgcgggcggaaggaggagaccgaggugcucuggaccucgaacuccaucguggucuucugcggcacgagcgggaccuacggcaccggguccuggcccgacggcgccgaccugaaccugaugcccaucuga

SEQ ID NO: 26310 - RNA, 1410 nt, Artificial Sequence
  derived and/or modified CDS sequence (AUadapt) from InfluenzaA__AGW01418__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacaugcacuccaacaacaccgugcgcgaccggacccccuaccgcacccugcugaugaacgagcucggcguccccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggugagcugguccaaggagauccugcgcacccaggagucggagugcgucugcaucaacgggacgugcaccguggugaugaccgacggcuccgccagcggcaaggccgacaccaagauccuguucaucgaggaggggaagaucguccacacgucgacccucuccggcucggcgcagcacguggaggagugcuccugcuacccccgguacccgggggugcgcugcgucugccgggacaacuggaagggcagcaaccgccccaucguggacaucaacaucaaggaccacuccaucgugucguccuacgucugcagcggccuggugggggacaccccgcggaagaacgacuccucguccagcucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggucaucguggaccgcggggaccgguccggcuacucggggaucuucuccguggagggcaagagcugcaucaaccggugcuucuacgucgagcugauccgcggccggaaggaggagaccggggugcucuggaccucgaacuccaucguggucuucugcggcacgagcgggaccuacggcaccggguccuggcccgacggcgccgaccugaaccugaugcccaucuga

SEQ ID NO: 26311 - RNA, 1410 nt, Artificial Sequence; identical to SEQ ID NO: 16339
  derived and/or modified CDS sequence (AUadapt) from InfluenzaA__AGW01430__NA

SEQ ID NO: 26312 - RNA, 1410 nt, Artificial Sequence; identical to SEQ ID NO: 16339
  derived and/or modified CDS sequence (AUadapt) from InfluenzaA__AGW01442__NA

SEQ ID NO: 26313 - RNA, 1410 nt, Artificial Sequence; identical to SEQ ID NO: 16339
  derived and/or modified CDS sequence (AUadapt) from InfluenzaA__AGW01454__NA

SEQ ID NO: 26314 - RNA, 1410 nt, Artificial Sequence; identical to SEQ ID NO: 16359
  derived and/or modified CDS sequence (AUadapt) from InfluenzaA__AGW01466__NA

SEQ ID NO: 26315 - RNA, 1410 nt, Artificial Sequence; identical to SEQ ID NO: 16339
  derived and/or modified CDS sequence (AUadapt) from InfluenzaA__AGW01478__NA

SEQ ID NO: 26316 - RNA, 1410 nt, Artificial Sequence
  derived and/or modified CDS sequence (AUadapt) from InfluenzaA__AGW01490__NA
augaaccccaaccagaagaucaucaccaucucguccgugagccugaccaucuccacgaucugcuucuucaugcagaucgccauccucaucaccaccgucacccugcacuucaagcaguacgaguucaacucgccgcccaacaaccaggugaugcugugcgagcccacgaucaucgagcgcaacaucaccgagaucguguaccucaccaacaccacgaucgagaaggagaucugccccaagccggccgaguaccggaacugguccaagccccagugcggcaucaccggguucgcgcccuucagcaaggacaacuccauccgccugucggccggcggggacaucugggucacccgggagcccuacguguccugcgacccggacaagugcuaccaguucgcccugggccaggggaccacgcucaacaacgugcacagcaacaacaccguccgcgaccggacccccuaccgcacccugcugaugaacgagcucggcgugcccuuccaccugggcacgaagcaggucugcaucgccugguccucguccagcugccacgacgggaaggccuggcugcacgugugcaucaccggcgacgacaagaacgcgaccgccuccuucaucuacaacgggcggcucguggacucgguggucuccuggagcaaggagauccugcgcacccaggaguccgagugcgugugcaucaacggcacgugcaccguggucaugaccgacgggucggccagcggcaaggccgacaccaagauccuguucaucgaggagggcaagaucgugcacacguccacccucucgggguccgcgcagcacguggaggagugcagcugcuacccccgguacccgggcguccgcugcgugugccgggacaacuggaagggguccaaccgccccaucguggacaucaacaucaaggaccacucgaucgucuccagcuacgugugcuccggccuggugggcgacacgccccggaagaacgacucguccagcuccucgcacugccuggaccccaacaacgaggagggcgggcacggggucaagggcugggccuucgacgacgggaacgacguguggaugggccgcaccaucaacgagaccucccggcucggcuacgagaccuucaaggucaucgagggguggagcaacuccaagucgaagcugcagaucaaccgccaggugaucguggaccggggcgaccgcuccggguacagcggcaucuucucggucgaggggaaguccugcaucaaccggugcuucuacguggagcugauccgcggccggaaggaggagaccgaggugcucuggaccagcaacuccaucgucguguucugcggcacgagcgggaccuacggcaccggguccuggccggacggcgccgaccugaaccugaugcccaucuga

SEQ ID NO: 26317 - RNA, 1410 nt, Artificial Sequence; identical to SEQ ID NO: 16339
  derived and/or modified CDS sequence (AUadapt) from InfluenzaA__AGW01538__NA

SEQ ID NO: 26318 - RNA, 1410 nt, Artificial Sequence; identical to SEQ ID NO: 16359
  derived and/or modified CDS sequence (AUadapt) from InfluenzaA__AGW01562__NA

SEQ ID NO: 26319 - RNA, 1410 nt, Artificial Sequence; identical to SEQ ID NO: 16339
  derived and/or modified CDS sequence (AUadapt) from InfluenzaA__AGW01574__NA

SEQ ID NO: 26320 - RNA, 1410 nt, Artificial Sequence; identical to SEQ ID NO: 16339
  derived and/or modified CDS sequence (AUadapt) from InfluenzaA__AGW01586__NA

SEQ ID NO: 26321 - RNA, 1410 nt, Artificial Sequence; identical to SEQ ID NO: 16339
  derived and/or modified CDS sequence (AUadapt) from InfluenzaA__AGW01598__NA

SEQ ID NO: 26322 - RNA, 1410 nt, Artificial Sequence; identical to SEQ ID NO: 16359
  derived and/or modified CDS sequence (AUadapt) from InfluenzaA__AGW01610__NA

SEQ ID NO: 26323 - RNA, 1410 nt, Artificial Sequence; identical to SEQ ID NO: 16339
  derived and/or modified CDS sequence (AUadapt) from InfluenzaA__AGW01622__NA

SEQ ID NO: 26324 - RNA, 1410 nt, Artificial Sequence; identical to SEQ ID NO: 16339
  derived and/or modified CDS sequence (AUadapt) from InfluenzaA__AGW01634__NA

SEQ ID NO: 26325 - RNA, 1410 nt, Artificial Sequence
  derived and/or modified CDS sequence (AUadapt) from InfluenzaA__AGW01646__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucgacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 26326 - RNA, 1410 nt, Artificial Sequence; identical to SEQ ID NO: 16339
  derived and/or modified CDS sequence (AUadapt) from InfluenzaA__AGW01670__NA

SEQ ID NO: 26327 - RNA, 1410 nt, Artificial Sequence; identical to SEQ ID NO: 16339
  derived and/or modified CDS sequence (AUadapt) from InfluenzaA__AGW01682__NA

SEQ ID NO: 26328 - RNA, 1410 nt, Artificial Sequence; identical to SEQ ID NO: 26285
  derived and/or modified CDS sequence (AUadapt) from InfluenzaA__AGW01704__NA

SEQ ID NO: 26329 - RNA, 1410 nt, Artificial Sequence
  derived and/or modified CDS sequence (AUadapt) from InfluenzaA__AGW01716__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacaugcacuccaacaacaccgugcgcgaccggacccccuaccgcacccugcugaugaacgagcucggcguccccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggugagcugguccaaggagauccugcgcacccaggagucggagugcgucugcaucaacgggacgugcaccguggugaugaccgacggcuccgccagcggcaaggccgacaccaagauccuguucaucgaggaggggaagaucguccacacgucgacccucuccggcucggcgcagcacguggaggagugcuccugcuacccccgguacccgggggugcgcugcgucugccgggacaacuggaagggcagcaaccgccccaucguggacaucaacaucaaggaccacuccaucgugucguccuacgucugcagcggccuggugggggacaccccgcggaagaacgacuccucguccagcucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggucaucguggaccgcggggaccgguccggcuacucggggaucuucuccguggagggccggagcugcaucaaccgcugcuucuacgucgagcugauccggggccgcaaggaggagaccgaggugcucuggaccucgaacuccaucguggucuucugcgggacgagcggcaccuacgggaccggcuccuggcccgacggggccgaccugaaccugaugcccaucuga

SEQ ID NO: 26330 - RNA, 1410 nt, Artificial Sequence
  derived and/or modified CDS sequence (AUadapt) from InfluenzaA__AGW01728__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacaugcacuccaacaacaccgugcgcgaccggacccccuaccgcacccugcugaugaacgagcucggcguccccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggugagcugguccaaggagauccugcgcacccaggagucggagugcgucugcaucaacgggacgugcaccguggugaugaccgacggcuccgccagcggcaaggccgacaccaagauccuguucaucgaggaggggaagaucguccacacgucgacccucuccggcucggcgcagcacguggaggagugcuccugcuacccccgguacccgggggugcgcugcgucugccgggacaacuggaagggcagcaaccgccccaucguggacaucaacaucaaggaccacuccaucgugucguccuacgucugcagcggccuggugggggacaccccgcggaagaacgacuccucguccagcucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggucaucguggaccgcggggaccgguccggcuacucggggaucuucuccguggagggcaagagcugcaucaaccggugcuucuacgucgagcugauccgcggccggaaggaggagaccgaggugcucuggaccucgaacuccguggucguguucugcgggacgagcggcaccuacgggaccggcuccuggcccgacggggccgaccugaaccugaugcccaucuga

SEQ ID NO: 26331 - RNA, 1410 nt, Artificial Sequence; identical to SEQ ID NO: 16339
  derived and/or modified CDS sequence (AUadapt) from InfluenzaA__AGW01740__NA

SEQ ID NO: 26332 - RNA, 1410 nt, Artificial Sequence
  derived and/or modified CDS sequence (AUadapt) from InfluenzaA__AGW01752__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucggcgggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcccaucuga

SEQ ID NO: 26333 - RNA, 1410 nt, Artificial Sequence; identical to SEQ ID NO: 16339
  derived and/or modified CDS sequence (AUadapt) from InfluenzaA__AGW01764__NA

SEQ ID NO: 26334 - RNA, 1410 nt, Artificial Sequence; identical to SEQ ID NO: 26285
  derived and/or modified CDS sequence (AUadapt) from InfluenzaA__AGW01776__NA

SEQ ID NO: 26335 - RNA, 1410 nt, Artificial Sequence; identical to SEQ ID NO: 16359
  derived and/or modified CDS sequence (AUadapt) from InfluenzaA__AGW01788__NA

SEQ ID NO: 26336 - RNA, 1410 nt, Artificial Sequence; identical to SEQ ID NO: 26285
  derived and/or modified CDS sequence (AUadapt) from InfluenzaA__AGW01800__NA

SEQ ID NO: 26337 - RNA, 1410 nt, Artificial Sequence; identical to SEQ ID NO: 16359
  derived and/or modified CDS sequence (AUadapt) from InfluenzaA__AGW01812__NA

SEQ ID NO: 26338 - RNA, 1410 nt, Artificial Sequence; identical to SEQ ID NO: 16359
  derived and/or modified CDS sequence (AUadapt) from InfluenzaA__AGW01824__NA

SEQ ID NO: 26339 - RNA, 1410 nt, Artificial Sequence; identical to SEQ ID NO: 26296
  derived and/or modified CDS sequence (AUadapt) from InfluenzaA__AGW01848__NA

SEQ ID NO: 26340 - RNA, 1410 nt, Artificial Sequence
  derived and/or modified CDS sequence (AUadapt) from InfluenzaA__AGW01860__NA
augaaccccaaccagaagaucaucaccaucggcucggugucccugaccaucagcacgaucugcuucuucaugcagaucgccauccucaucaccaccgucacccugcacuucaagcaguacgaguucaacucccugccgaacaaccaggugaugcucugcgagcccacgaucaucgagcgcaacaucaccgagaucguguaccugaccaacaccacgaucgagaaggagaucugccccaagcccgccgaguaccggaacuggucgaagccgcagugcgggaucaccggcuucgcgcccuucuccaaggacaacagcauccgccuguccgccgggggcgacaucugggucacccgggagcccuacgugucgugcgaccccgacaagugcuaccaguucgcccucgggcagggcaccacgcugaacaacgugcacuccaacaacaccguccgcgaccggaccccguaccgcacccugcucaugaacgagcugggcgugcccuuccaccuggggacgaagcaggucugcaucgccuggagcuccucguccugccacgacggcaaggccuggcuccacgugugcaucaccggggacgacaagaacgcgaccgccagcuucaucuacaacggccggcugguggacuccguggucucgugguccaaggagauccugcgcacccaggagagcgagugcgugugcaucaacgggacgugcaccguggucaugaccgacggcuccgccucgggcaaggccgacaccaagauccucuucaucgaggaggggaagaucgugcacacgagcacccuguccggcagcgcgcagcacguggaggagugcuccugcuacccccgguaccccgggguccgcugcgugugccgggacaacuggaagggcucgaaccgcccgaucguggacaucaacaucaaggaccacuccaucgucagcuccuacgugugcucgggccuggugggggacacgccccggaagaacgacuccagcuccucgucccacugcuucgaccccaacaacgaggagggcgggcacggcgucaaggggugggccuucgacgacggcaacgacguguggaugggccgcaccaucaacgagaccagccggcucggguacgagaccuucaaggucaucggcgggugguccaaccccaagucgaagcugcagaucaaccgccaggugaucguggaccggggcgaccgcuccggguacagcggcaucuucuccgucgagggcaagucgugcaucaaccggugcuucuacguggagcugauccgcgggcggaaggaggagaccgaggugcucuggaccagcaacuccaucaucgucuucugcggcacgagcgggaccuacggcaccggguccuggccggacggcgccgaccugaaccugaugcccaucuga

SEQ ID NO: 26341 - RNA, 1410 nt, Artificial Sequence
  derived and/or modified CDS sequence (AUadapt) from InfluenzaA__AGW01884__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccaagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 26342 - RNA, 1410 nt, Artificial Sequence; identical to SEQ ID NO: 16339
  derived and/or modified CDS sequence (AUadapt) from InfluenzaA__AGW01896__NA

SEQ ID NO: 26343 - RNA, 1410 nt, Artificial Sequence; identical to SEQ ID NO: 16339
  derived and/or modified CDS sequence (AUadapt) from InfluenzaA__AGW01908__NA

SEQ ID NO: 26344 - RNA, 1410 nt, Artificial Sequence; identical to SEQ ID NO: 16339
  derived and/or modified CDS sequence (AUadapt) from InfluenzaA__AGW01920__NA

SEQ ID NO: 26345 - RNA, 1410 nt, Artificial Sequence; identical to SEQ ID NO: 16339
  derived and/or modified CDS sequence (AUadapt) from InfluenzaA__AGW01932__NA

SEQ ID NO: 26346 - RNA, 1410 nt, Artificial Sequence
  derived and/or modified CDS sequence (AUadapt) from InfluenzaA__AGW01944__NA
augaaccccaaccagaagaucaucaccaucggcucggugucccugaccaucagcacgaucugcuucuucaugcagaucgccauccucaucaccaccgucacccugcacuucaagcaguacgaguucaacuucccgcccaacaaccaggugaugcugugcgagcccacgaucaucgagcgcaacaucaccgagaucguguaccucaccaacaccacgaucgagaaggagaucugccccaagccggccgaguaccggaacugguccaagccccagugcgggaucaccggcuucgcgcccuucucgaaggacaacuccauccgccugagcgccgggggcgacaucugggucacccgggagcccuacguguccugcgacccggacaagugcuaccaguucgcccuggggcagggcaccacgcucaacaacgugcacucgaacaacaccguccgcgaccggacccccuaccgcacccugcugaugaacgagcucggcgugcccuuccaccuggggacgaagcaggucugcaucgccugguccagcuccucgugccacgacggcaaggccuggcugcacgugugcaucaccggggacgacaagaacgcgaccgccuccuucaucuacaacggccggcucguggacagcguggucuccuggucgaaggagauccugcgcacccaggaguccgagugcgugugcaucaacgggacgugcaccguggucaugaccgacggcagcgccuccggcaaggccgacaccaagauccuguucaucgaggaggggaagaucgugcacacgucgacccucagcggcuccgcgcagcacguggaggagugcucgugcuacccccgguacccggggguccgcugcgugugccgggacaacuggaagggcuccaaccgccccaucguggacaucaacaucaaggaccacagcaucgucuccucguacgugugcuccggccuggugggggacacgccccggaagaacgacagcuccucguccagccacugccuggcccccaacaacgaggagggcgggcacggcgucaaggggugggccuucgacgacggcaacgacguguggaugggccgcaccaucaacgagaccucccggcucggguacgagaccuucaaggucaucgagggcuggucgaacccgaaguccaagcugcagaucaaccgccaggugaucguggaccgcggggaccggagcggcuacuccgggaucuucucggucgagggcaaguccugcaucaaccggugcuucuacguggagcugauccgcggccggaaggaggagaccgaggugcucuggaccagcaacucgaucgucguguucugcgggacguccggcaccuacgggaccggcagcuggcccgacggggccgaccugaaccugaugcccaucuga

SEQ ID NO: 26347 - RNA, 1410 nt, Artificial Sequence; identical to SEQ ID NO: 16339
  derived and/or modified CDS sequence (AUadapt) from InfluenzaA__AGW01956__NA

SEQ ID NO: 26348 - RNA, 1410 nt, Artificial Sequence
  derived and/or modified CDS sequence (AUadapt) from InfluenzaA__AGW01968__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccauccgcgaccggacccccuaccgcacccugcugaugaacgagcucggcguccccuuccaccugggcacgaagcaggucugcaucgccuggucguccucguccugccacgacgggaaggccuggcugcacgugugcaucaccggcgacgacgagaacgcgaccgccagcuucaucuacaacgggcggcucguggacuccguggugucgugguccaaggagauccugcgcacccaggagagcgagugcgucugcaucaacggcacgugcaccguggugaugaccgacggguccgccucgggcaaggccgacaccaagauccuguucaucgaggagggcaagaucguccacacgagcacccucuccgggucggcgcagcacguggaggagugcuccugcuacccccgguacccgggcgugcgcugcgucugccgggacaacuggaaggggucgaaccgccccaucguggacaucaacaucaaggaccacuccaucgugagccgguacgucugcuccggccuggugggcgacacgccccgcaagaacgacucguccagcuccucgcacugccuggaccccaacaacgaggagggcgggcacggggugaagggcugggccuucgacgacgggaacgacgucuggaugggccggaccaucaacgagaccucccgccucggcuacgagaccuucaaggugaucgagggguggucgaacccgaaguccaagcugcagaucaaccggcaggucaucguggaccgcggcgaccggagcggguacuccggcaucuucucgguggaggggaaguccugcaucaaccgcugcuucuacgucgagcugauccggggccgcaaggaggagaccgaggugcucuggaccagcaacucgaucguggucuucugcggcacguccgggaccuacggcaccgggagcuggcccgacggcgccgaccugaaccugaugcccaucuga

SEQ ID NO: 26349 - RNA, 1410 nt, Artificial Sequence; identical to SEQ ID NO: 16359
  derived and/or modified CDS sequence (AUadapt) from InfluenzaA__AGW01980__NA

SEQ ID NO: 26350 - RNA, 1410 nt, Artificial Sequence; identical to SEQ ID NO: 16339
  derived and/or modified CDS sequence (AUadapt) from InfluenzaA__AGW01992__NA

SEQ ID NO: 26351 - RNA, 1410 nt, Artificial Sequence; identical to SEQ ID NO: 16339
  derived and/or modified CDS sequence (AUadapt) from InfluenzaA__AGW02004__NA

SEQ ID NO: 26352 - RNA, 1410 nt, Artificial Sequence; identical to SEQ ID NO: 16339
  derived and/or modified CDS sequence (AUadapt) from InfluenzaA__AGW02016__NA

SEQ ID NO: 26353 - RNA, 1410 nt, Artificial Sequence; identical to SEQ ID NO: 16339
  derived and/or modified CDS sequence (AUadapt) from InfluenzaA__AGW02040__NA

SEQ ID NO: 26354 - RNA, 1410 nt, Artificial Sequence
  derived and/or modified CDS sequence (AUadapt) from InfluenzaA__AGW02064__NA
augaaccccaaccagaagaucaucaccaucggcucggugucccugaccaucucgacgaucugcuucuucaugcagaucgccauccucaucaccaccgucacccugcacuucaagcaguacgaguucgacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggagauccugcgcacccaggagagcgagugcgugugcaucaacgggacgugcaccguggucaugaccgacggcuccgccucgggcaaggccgacaccaagauccuguucaucgaggaggggaagaucgugcacacgagcacccucuccggcucggcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacacgccccggaagaacgacuccagcuccucgggccacugccuggaccccaacaacgaggagggcgggcacggggucaagggcugggccuucgacgacggcaacgacguguggauggggcgcaccaucaacgagaccucccggcucggcuacgagaccuucaaggucaucgagggguggucgaacccgaaguccaagcugcagaucaaccgccaggugaucguggaccggggcgaccgcagcggguacuccggcaucuucucggucgagggcaaguccugcaucaaccggugcuucuacguggagcugauccgcgggcggaaggaggagaccgaggugcucuggaccagcaacucgaucgucguguucugcggcacguccgggaccuacggcaccgggagcuggcccgacggcgccgaccugaaccugaugcccaucuga

SEQ ID NO: 26355 - RNA, 1410 nt, Artificial Sequence; identical to SEQ ID NO: 16339
  derived and/or modified CDS sequence (AUadapt) from InfluenzaA__AGW02076__NA

SEQ ID NO: 26356 - RNA, 1410 nt, Artificial Sequence; identical to SEQ ID NO: 16339
  derived and/or modified CDS sequence (AUadapt) from InfluenzaA__AGW02088__NA

SEQ ID NO: 26357 - RNA, 1410 nt, Artificial Sequence
  derived and/or modified CDS sequence (AUadapt) from InfluenzaA__AGW02100__NA
augaaccccaaccagaagaucaucaccaucggcucggugucccugaccaucucgacgaucugcuucuucaugcagaucgccauccucaucaccaccgucacccugcacuucaagcaguacgaguccaacagcccgcccaacaaccaggugaugcugugcgagcccacgaucaucgagcgcaacaucaccgagaucguguaccucaccaacaccacgaucgagaaggagaucugccccaagccggccgaguaccggaacugguccaagccccagugcgggaucaccggcuucgcgcccuucucgaaggacaacuccauccgccugagcgccgggggcgacaucugggucacccgggagcccuacguguccugcgacccggacaagugcuaccaguucgcccuggggcagggcaccacgcucaacaacgugcacucgaacaacaccguccgcgaccggacccccuaccgcacccugcugaugaacgagcucggcgugcccuuccaccuggggacgaagcaggucugcaucgccugguccucguccagcugccacgacggcaaggccuggcugcacgugugcaucaccggggacgacaagaacgcgaccgccuccuucaucuacaacggccggcucguggacucgguggucuccuggagcaaggagauccugcgcacccaggaguccgagugcgugugcaucaacgggacgugcaccguggucaugaccgacggcucggccucgggcaaggccgacaccaagauccuguucaucgaggaggggaagaucgugcacacguccacccucagcggcuccgcgcagcacguggaggagugcucgugcuacccccgguacccggggguccgcugcgugugccgggacaacuggaagggcuccaaccgccccaucguggacaucaacaucaaggaccacagcaucgucuccucguacgugugcuccggccuggugggggacacgccccggaagaacgacucguccagcuccucgcacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggagcaacccgaaguccaagcugcagaucaaccgccaggugaucguggaccgcggggaccggucgggcuacuccgggaucuucucggucgagggcaagagcugcaucaaccggugcuucuacguggagcugauccgcggccggaaggaggagaccgaggugcucuggaccuccaacucgaucgucguguucugcgggacguccggcaccuacgggaccggcagcuggcccgacggggccgaccugaaccugaugcccaucuga

SEQ ID NO: 26358 - RNA, 1410 nt, Artificial Sequence; identical to SEQ ID NO: 26285
  derived and/or modified CDS sequence (AUadapt) from InfluenzaA__AGW02112__NA

SEQ ID NO: 26359 - RNA, 1410 nt, Artificial Sequence
  derived and/or modified CDS sequence (AUadapt) from InfluenzaA__AGW02124__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccgucucggaccgcacccccuaccggacccugcugaugaacgagcucggcgugcccuuccaccuggggacgaagcaggucugcaucgccugguccagcuccucgugccacgacggcaaggccuggcugcacgugugcaucaccggggacgacaagaacgcgaccgccuccuucaucuacaacggccgccucguggacagcguggucuccuggucgaaggagauccugcggacccaggaguccgagugcgugugcaucaacgggacgugcaccguggucaugaccgacggcagcgccucgggcaaggccgacaccaagauccuguucaucgaggaggggaagaucgugcacacguccacccucagcggcuccgcgcagcacguggaggagugcucgugcuacccccgcuacccggggguccggugcgugugccgcgacaacuggaagggcuccaaccggcccaucguggacaucaacaucaaggaccacagcaucgucuccucguacgugugcuccggccuggugggggacacgccccgcaagaacgacagcuccucguccagccacugccuggaccccaacaacgaggagggcgggcacggcgucaaggggugggccuucgacgacggcaacgacguguggaugggccggaccaucaacgagaccucccgccucggguacgagaccuucaaggucaucgagggcuggucgaacccgaaguccaagcugcagaucaaccggcaggucaucguggaccgcggggaccggagcggcuacuccgggaucuucucgguggagggcaagagcugcaucaaccgcugcuucuacguggagcugauccggggccgcaaggaggagaccgaggugcucuggaccuccaacucgaucgucguguucugcgggacguccggcaccuacgggaccggcagcuggcccgacggggccgaccugaaccugaugcccaucuga

SEQ ID NO: 26360 - RNA, 1410 nt, Artificial Sequence; identical to SEQ ID NO: 16359
  derived and/or modified CDS sequence (AUadapt) from InfluenzaA__AGW02136__NA

SEQ ID NO: 26361 - RNA, 1410 nt, Artificial Sequence; identical to SEQ ID NO: 26285
  derived and/or modified CDS sequence (AUadapt) from InfluenzaA__AGW02148__NA

SEQ ID NO: 26362 - RNA, 1410 nt, Artificial Sequence
  derived and/or modified CDS sequence (AUadapt) from InfluenzaA__AGW02160__NA
augaaccccaaccagaagaucaucaccaucggcucggugucccugaccaucucgacgaucugcuucuucaugcagaucgccauccucaucaccaccgucacccugcacuucaagcaguacgaguucgacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcagcgcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacaccccgcggaagaacgacuccagcuccucgucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagucgaagcugcagaucaaccgccaggugaucguggaccgguccgaccgcagcggguacuccggcaucuucucggucgagggcaagagcugcaucaaccggugcuucuacguggagcugauccgcgggcggaaggaggagaccgaggugcucuggaccuccaacucgaucgucguguucugcggcacguccgggaccuacggcaccgggagcuggcccgacggcgccgaccugaaccugaugcccaucuga

SEQ ID NO: 26363 - RNA, 1410 nt, Artificial Sequence; identical to SEQ ID NO: 16339
  derived and/or modified CDS sequence (AUadapt) from InfluenzaA__AGW02172__NA

SEQ ID NO: 26364 - RNA, 1410 nt, Artificial Sequence; identical to SEQ ID NO: 16339
  derived and/or modified CDS sequence (AUadapt) from InfluenzaA__AGW02184__NA

SEQ ID NO: 26365 - RNA, 1410 nt, Artificial Sequence
  derived and/or modified CDS sequence (AUadapt) from InfluenzaA__AGW02196__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaucaacaccaccaucgagaaggagaucugccccaagccggccgaguaccggaacuggucgaagccccagugcgggaucacgggcuucgcgcccuucuccaaggacaacagcauccgccuguccgccgggggcgacaucugggucacccgggagcccuacgugucgugcgacccguacaagugcuaccaguucgcccuggggcagggcaccacccucaacaacgugcacuccaacaacacgguccgcgaccggacccccuaccgcacccugcugaugaacgagcucggcgugcccuuccaccuggggaccaagcaggucugcaucgccuggagcuccucguccugccacgacggcaaggccuggcugcacgugugcaucacgggggacgacaagaacgcgaccgccagcuucaucuacaacggccggcucguggacuccguggucucgugguccaaggagauccugcgcacccaggagagcgagugcgugugcaucaacgggaccugcacgguggucaugaccgacggcuccgccucgggcaaggccgacaccaagauccuguucaucgaggaggggaagaucgugcacaccagcacgcucuccggcagcgcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacaccccgcggaagaacgacuccagcuccucgucccacugccuggaccccaacaacgaggagggcgggcacggcgucaaggggugggccuucgacgacggcaacgacguguggaugggccgcaccaucaacgagaccagccggcucggguacgagacguucaaggucaucgagggcugguccaaccccaagucgaagcugcagaucaaccgccaggugaucguggaccgcggggaccgguccggcuacagcgggaucuucuccgucgagggcaagucgugcaucaaccggugcuucuacguggagcugauccgcggccggaaggaggagaccgaggugcucuggaccagcaacuccaucgucguguucugcgggaccagcggcacguacgggaccggcuccuggcccgacggggccgaccugaaccugaugcccaucuga

SEQ ID NO: 26366 - RNA, 1410 nt, Artificial Sequence; identical to SEQ ID NO: 25777
  derived and/or modified CDS sequence (AUadapt) from InfluenzaA__AGW04174__NA

SEQ ID NO: 26367 - RNA, 1410 nt, Artificial Sequence
  derived and/or modified CDS sequence (AUadapt) from InfluenzaA__AGW25784__NA
augaaccccaaccagaagaucaucaccaucggcucggugucccugaucaucgccaccaucugcuuccucaugcagaucgccauccuggucacgaccgugacccugcacuucaagcaguacggguacaacagccucccgaacaaccaggugaugcugugcgagcccaccaucaucgagcgcaacaucacggagaucgucuaccugaccaacaccaccaucgagaaggagaucugccccaagcucgcggaguaccggaacugguccaagccccagugcaagaucacgggcuucgccccguucucgaaggacaacuccauccgccugagcgccgggggcgacaucugggugacccgggagcccuacguguccugcgaccccuacaagugcuaccaguucgcccuggggcagggcaccacccucaacaacaagcacucgaacgacacgguccacgaccgcacccccuaccggacccugcugaugaacgagcucggcgugccguuccaccuggggaccaagcaggucugcaucgccugguccagcuccucgugccacgacggcaaggcguggcugcacaucugcgugacggggcacgacgagaacgccaccgccuccuucaucuacgacggcaagcucguggacagcaucggguccuggucgaagaagauccugcgcacccaggaguccgagugcgugugcaucaacgggaccugcacggucgugaugaccgacggcagcgccuccgggcgggcggacaccaagauccuguucaucgaggagggcaagaucauccacaucucgcagcucagcggguccgcccagcacguggaggagugcucgugcuacccccgcuaccccggcauccggugcgucugccgcgacaacuggaagggcuccaaccggcccaucguggacaucaacgugaaggacuacagcaucaccuccucguacgucugcuccgggcuggugggcgacacgccgcgcaagaccgacaacagcuccucgucccacugccugaaccccaacaacgaggagggcggccacggggugaagggcugggccuucgacgacggcaacgacgucuggauggggcggaccaucagcgagaaguuccgcuccggcuacgagaccuucaaggugaucaagggguggucgaagcccaacuccaagcuccagaucaaccgccaggugaucgucgaccgggacaaccggagcggcuacuccgggaucuucucgguggagggcaaguccugcaucaaccgcugcuucuacgucgagcugauccggggccgcaagcgggaggccgaggugugguggacgagcaacucgaucguggucuucugcgggaccuccggcaccuacgggaccggcagcuggcccgacggggccgacaucaaccugaugccgaucuga

SEQ ID NO: 26368 - RNA, 1350 nt, Artificial Sequence
  derived and/or modified CDS sequence (AUadapt) from InfluenzaA__AGW27062__NA
augaaucccaaccaaaagaucgugaccaucggcagcaucugcauggucaucgggaccaucucccugaugcuccagaucggcaacaucaucagcaucugggugucccacaguauccagacggggaaccagcaccagaccgagccgauccgcaacaccaacuuccugaccgagaacgccguggccuccgucacgcuggcgggcaauagcucccucugccccauccgggggugggccgugcacagcaaggacaacuccauccgcaucggcaguaagggcgacguguucgucauccgggagcccuucaucuccugcagccaccuggagugucgcaccuucuuccugacccagggggcccuccugaacgacaagcacuccaacggcaccgugaaggaucggagcccccaccgcacgcugauguccugcccgaucggggaggcccccagccccuacaacucccgguuugagagcguggccugguccgcgagcgccugccacgacggcaccagcuggcucgucaucgggaucuccggccccgacaauggcgccguggccgugcugaaguacaacgggaucaucaccgacaccauccgcagcuggcggaacaacauccugcgcacgcaggaguccgagugugcgugcgucaacggcagcugcuucaccgugaugaccgacgggccguccaauggccaggccagcuacaagaucuucaagaucgagaagggcaagguggucaaguccguggagcucaacgcccccaacuaccauuacgaggagugcagcugcuaccccgacgccggggagaucacgugugugugccgggacaacuggcacggcuccaaccgccccugggucagcuuuaaccagaaccuggaguaccagaucggguacaucugcuccggcguguucggggacaauccgcggcccaacgacggcaccggcagcugcgggcccguguccagcaacggcgccuauggggucaagggcuucuccuucaaguacgggaacggcguguggaucggccgcaccaagagcacccacucccggaguggguucgagaugaucugggaccccaacggcuggaccgggacggacuccgaguucagcaugaagcaggauaucguggcgaucaccgacuggagcggcuacuccgggagcuucguccagcacccggagcugaccggccucgauugcauccgccccugcuucuggguggagcugauccggggccgccccaaggaguccaccaucuggacgagcggguccagcaucuccuucuguggcgucaacagcgacaccguguccuggagcuggcccgacggggccgagcugccguucaccaucgacaaguga

SEQ ID NO: 26369 - RNA, 1410 nt, Artificial Sequence
  derived and/or modified CDS sequence (AUadapt) from InfluenzaA__AGY14472__NA
augaaccccaaccagaagaucaucaccaucggcucggugucccugacccucgccacgaucugcuuccugaugcagaucgccauccuggucaccaccgugacccuccacuucaagcaguacgagugcaacucgacgccgaacaaccaggugaugcugugcgagcccaccgucaucgagcgcaacaucaccaagaucguguaccugaccaacacgaccguggagaaggagaucugccccaagcccgcggaguaccggaacugguccaagccgcagugcaagaucaccggguucgcccccuucagcaaggacaacuccauccgccucucggccggcggggacaucugggucacccgggagcccuacguguccugcgaccccaacaagugcuaccaguucgcccugggccaggggacgacccugaacaaccgccacucgaacgacaccgugcacgaccggaccccguaccgcacgcuccugaugaacgagcugggcauccccuuccaccucggcaccaagcaggucugcaucgccugguccagcuccucgugccacgacgggaaggcguggcugcacgugugcgugaccggccacgacaagaacgccaccgccuccuucaucuacgacgggaagcuggucgacucgaucggcuccuggagcaagaagauccuccggacgcaggaguccgagugcgugugcaucaacgggaccugcaccguggucaugaccgacggcucggccuccggccgcgcggacacgaagauccuguucaucgaggaggggaagaucauccacaucucgcagcugagcggcuccgcccagcacguggaggagugcucgugcuacccccgguaccccgggauccgcugcgugugccgggacaacuggaagggcuccaaccgcccgaucgucgacaucaacgugaaggacuacucgaucaccuccagcuacgugugcuccggccucgucggggacacgccccggaagaccgacaacucguccucgucccacugccugaaccccaacaacgaggagggcgggcacggcgugaaggggugggccuucgacgacggcaacgacguguggaugggccgcaccaucagcgagaaguuccgguccggguacgagaccuucaaggucaucaagggcuggucgaagcccaacuccaagcugcagaucaaccgccaggugaucgucgaccgggacaaccgcucgggguacuccggcaucuucagcguggaggggaaguccugcaucaaccggugcuucuacguggagcucauccgcggccggaagcgcgaggccgaggucugguggaccucgaacucgaucgugguguucugcggcaccuccgggacguacggcaccgggagcuggccggacggcgccgacaucaaccugaugcccaucuga

SEQ ID NO: 26370 - RNA, 1398 nt, Artificial Sequence
  derived and/or modified CDS sequence (AUadapt) from InfluenzaA__AHA11501__NA
augaaucccaaccagaagauccugugcaccucggccaccgccaucaucaucggcgcgaucgccgugcucaucgggaucgccaaccugggccugaacaucgggcuccaccugaagccgggcugcaacugcucccacucgcagcccgagacgaccaacaccucccagaccaucaucaacaacuauuacaacgagacgaacaucaccaacauccagauggaggagcgcaccucgcggaacuucaacaaccugaccaaggggcucugcacgaucaacuccuggcacaucuacggcaaggacaacgccguccgcaucggcgagaguuccgacgugcuggugacccgggagcccuacgucucgugcgaccccgacgagugccgcuucuacgcccugucccaggggaccaccauccggggcaagcacucgaacgggacgauccacgaccgcucccaguaccgggcgcucaucaguuggccgcuguccucgccgcccaccguguacaacucccgcguggagugcaucggcuggucguccaccucgugccacgacgggaagucccggaugucgaucugcaucucgggccccaacaacaacgccuccgccgucgugugguauaaccgccggcccguggccgagaucaacaccugggcgcgcaacauccugcggacgcaggagucggagugcgucugccacaacggcgugugccccaucguguucaccgacggguccgccaccggccccgccgacacccgcaucuacuacuuuaaggaggggaagauccucgagugggagucgcugacgggcaccgccaagcacaucgaggagugcuccugcuacggcgagcggaccgggaucacgugcacgugccgcgacaacuggcagggcucgaaccggcccgucauccagaucgacccgguggccaugacccacaccucccaguacaucugcagucccgugcugaccgacacgccccgccccaacgacccgaacaucgggaagugcaacgaccccuaccccggcaacgacaacaacggggucaagggcuucuccuaccucgacggcgcgaauaccuggcuggggcggaccaucucgaccgccucccgcucgggcuacgagaugcugaaggugcccaacgcccucaccgacgaccgguccaagccgauccaggggcagaccaucgugcugaacgccgacuggucgggcuacuccgggucguucauggacuacugggccgagggcgacuguuaccgcgcgugcuucuacgucgagcugauccgcggccggcccaaggaggacaaggugugguggaccuccaacucgaucguguccaugugcucgucgaccgaguuccucgggcaguggaacuggcccgacggcgcccgcaucgaguacuuccuguga

SEQ ID NO: 26371 - RNA, 1410 nt, Artificial Sequence
  derived and/or modified CDS sequence (AUadapt) from InfluenzaA__AHC57462__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugcugggaccccaacaacgaggagggcgggcacggggucaagggcugggccuucgacgacgggaacgacguguggaugggccgcaccaucaacgagaccucgcggcucggcuacgagaccuucaaggucaucgaggggugguccaaccccaagagcaagcuccaggugaaccgccaggugaucgucgaccggggcgaccgcuccggguacucgggcaucuucuccguggagggcaagagcugcaucaaccggugcuucuacguggagcugauccgcgggcggaaggaggagaccgagguccuguggaccucgaacuccaucgugguguucugcggcacgagcgggaccuacggcaccggguccuggccggacggcgccgaccugaaccugaugcccaucuga

SEQ ID NO: 26372 - RNA, 1410 nt, Artificial Sequence; identical to SEQ ID NO: 21920
  derived and/or modified CDS sequence (AUadapt) from InfluenzaA__AHC57490__NA

SEQ ID NO: 26373 - RNA, 1410 nt, Artificial Sequence
  derived and/or modified CDS sequence (AUadapt) from InfluenzaA__AHC57514__NA
augaaccccaaccagaagaucaucaccaucggcucggugucccugaccaucagcacgaucugcuucuucaugcagaucgccauccucaucaccaccgucacccugcacuucaagcaguacgaguucuacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccucgucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagucgaagcugcagaucaaccgccaggugaucguggaccggggcaaccgcuccggguacagcggcaucuucuccgucgagggcaagucgugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 26374 - RNA, 1410 nt, Artificial Sequence; identical to SEQ ID NO: 26373
  derived and/or modified CDS sequence (AUadapt) from InfluenzaA__AHC57526__NA

SEQ ID NO: 26375 - RNA, 1410 nt, Artificial Sequence; identical to SEQ ID NO: 26373
  derived and/or modified CDS sequence (AUadapt) from InfluenzaA__AHC57806__NA

SEQ ID NO: 26376 - RNA, 1410 nt, Artificial Sequence; identical to SEQ ID NO: 26373
  derived and/or modified CDS sequence (AUadapt) from InfluenzaA__AHC57818__NA

SEQ ID NO: 26377 - RNA, 1410 nt, Artificial Sequence
  derived and/or modified CDS sequence (AUadapt) from InfluenzaA__AHC57830__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcugcagaucaaccgccaggugaucguggaccggggcaaccgguccggguacucgggcaucuucuccgucgagggcaagagcugcaucaaccgcugcuucuacguggagcucauccgggggcgcaaggaggagaccgaggugcuguggaccucgaacuccaucgucguguucugcggcacgagcgggaccuacggcaccggguccuggccggacggcgccgaccugaaccucaugcccaucuga

SEQ ID NO: 26378 - RNA, 1410 nt, Artificial Sequence; identical to SEQ ID NO: 26377
  derived and/or modified CDS sequence (AUadapt) from InfluenzaA__AHC57971__NA

SEQ ID NO: 26379 - RNA, 1410 nt, Artificial Sequence; identical to SEQ ID NO: 26373
  derived and/or modified CDS sequence (AUadapt) from InfluenzaA__AHC57984__NA

SEQ ID NO: 26380 - RNA, 1410 nt, Artificial Sequence
  derived and/or modified CDS sequence (AUadapt) from InfluenzaA__AHC57996__NA
augaaccccaaccagaagaucaucaccaucggcucggugucccugaccaucagcacgaucugcuucuucaugcagaucgccauccucaucaccaccgucacccugcacuucaagcaguacgaguucuacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccgcaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggaccggggcaaccgcuccggguacucgggcaucuucuccgucgagggcaagagcugcaucaaccggugcuucuacguggagcucauccgcgggcggaaggaggagaccgaggugcuguggaccucgaacuccaucgucguguucugcggcacgagcgggaccuacggcaccggguccuggccggacggcgccgaccugaaccucaugcccaucuga

SEQ ID NO: 26381 - RNA, 1410 nt, Artificial Sequence; identical to SEQ ID NO: 25324
  derived and/or modified CDS sequence (AUadapt) from InfluenzaA__AHC58008__NA

SEQ ID NO: 26382 - RNA, 1410 nt, Artificial Sequence; identical to SEQ ID NO: 21920
  derived and/or modified CDS sequence (AUadapt) from InfluenzaA__AHC58020__NA

SEQ ID NO: 26383 - RNA, 1410 nt, Artificial Sequence
  derived and/or modified CDS sequence (AUadapt) from InfluenzaA__AHC58032__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucaaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcugcagaucaaccgccaggugaucguggaccggggcaaccgguccggguacucgggcaucuucuccgucgagggcaagagcugcaucaaccgcugcuucuacguggagcucauccgggggcgcaaggaggagaccgaggugcuguggaccucgaacuccaucgucguguucugcggcacgagcgggaccuacggcaccggguccuggccggacggcgccgaccugaaccucaugcccaucuga

SEQ ID NO: 26384 - RNA, 1410 nt, Artificial Sequence; identical to SEQ ID NO: 25324
  derived and/or modified CDS sequence (AUadapt) from InfluenzaA__AHC58053__NA

SEQ ID NO: 26385 - RNA, 1410 nt, Artificial Sequence
  derived and/or modified CDS sequence (AUadapt) from InfluenzaA__AHC58077__NA
augaaccccaaccagaagaucaucaccaucggcucggugucccugaccaucucgacgaucugcuucuucaugcagaucgccauccucaucaccaccgucacccugcacuucaagcaguacgaguucuacuccccgcccaacaaccaggugaugcugcgcgagcccacgaucaucgagcggaacaucaccgagaucguguaccucaccaacaccacgaccgagaaggagaucugccccaagcuggccgaguaccgcaacuggagcaagccgcagugcgacaucaccggguucgcgcccuucuccaaggacaacucgauccggcuguccgccggcggggacaucugggucacccgcgagcccuacgugagcugcgaccccgacaagugcuaccaguucgcccucggccaggggacgacccugaacaacgugcacuccaacaacaccguccgggaccgcaccccguaccggacgcugcucaugaacgagcugggcgugcccuuccaccugggcaccaagcaggucugcaucgccuggucguccagcuccugccacgacgggaaggccuggcuccacgugugcaucaccggcgacgacaagaacgcgaccgccucguucaucuacaacgggcgccugguggacuccguggucagcugguccaaggagauccugcggacgcaggagucggagugcgugugcaucaacgggaccugcaccguggucaugaccgacggguccgccagcggcaaggccgacacgaagauccucuucaucgaggagggcaagaucgugcacaccucgacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcggccacggggucaagggcugggccuucgacgacgggaacgacguguggaugggccggaccaucaacgagaccucgcgccugggcuacgagaccuucaaggucaucgaggggugguccaaccccaagagcaagcugcagaucaaccgccaggugaucguggaccggggcaaccgguccggguacucgggcaucuucuccgucgagggcaagagcugcaucaaccgcugcuucuacguggagcucauccgggggcgcaaggaggagaccgaggugcuguggacgucgaacuccaucgucguguucugcggcaccagcgggaccuacggcaccggguccuggccggacggcgccgaccugaaccucaugcccaucuga

SEQ ID NO: 26386 - RNA, 1410 nt, Artificial Sequence; identical to SEQ ID NO: 26377
  derived and/or modified CDS sequence (AUadapt) from InfluenzaA__AHC58089__NA

SEQ ID NO: 26387 - RNA, 1410 nt, Artificial Sequence; identical to SEQ ID NO: 26373
  derived and/or modified CDS sequence (AUadapt) from InfluenzaA__AHC58101__NA

SEQ ID NO: 26388 - RNA, 1410 nt, Artificial Sequence
  derived and/or modified CDS sequence (AUadapt) from InfluenzaA__AHC58113__NA
augaaccccaaccagaagaucaucaccaucggcucggugucccugaccaucagcacgaucugcuucuucaugcagaucgccauccucaucaccaccgucacccugcacuucaagcaguacgaguucuacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaagaagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccucgucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagucgaagcugcagaucaaccgccaggugaucguggaccggggcaaccgcuccggguacagcggcaucuucuccgucgagggcaagucgugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 26389 - RNA, 1410 nt, Artificial Sequence; identical to SEQ ID NO: 26373
  derived and/or modified CDS sequence (AUadapt) from InfluenzaA__AHC58129__NA

SEQ ID NO: 26390 - RNA, 1410 nt, Artificial Sequence; identical to SEQ ID NO: 26373
  derived and/or modified CDS sequence (AUadapt) from InfluenzaA__AHC58153__NA

SEQ ID NO: 26391 - RNA, 1410 nt, Artificial Sequence; identical to SEQ ID NO: 26373
  derived and/or modified CDS sequence (AUadapt) from InfluenzaA__AHC58165__NA

SEQ ID NO: 26392 - RNA, 1410 nt, Artificial Sequence; identical to SEQ ID NO: 26377
  derived and/or modified CDS sequence (AUadapt) from InfluenzaA__AHC58177__NA

SEQ ID NO: 26393 - RNA, 1410 nt, Artificial Sequence
  derived and/or modified CDS sequence (AUadapt) from InfluenzaA__AHC58189__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggucgaagccccagugcgacaucaccggguucgcgcccuucuccaaggacaacagcauccgccuguccgccggcggggacaucugggucacccgggagcccuacgugucgugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccucguccugccacgacgggaaggccuggcugcacgugugcaucaccggcgacgacaagaacgcgaccgccagcuucaucuacaacgggcggcucguggacuccguggucucgugguccaaggagauccugcgcacccaggagagcgagugcgugugcaucaacggcacgugcaccguggucaugaccgacggguccgccucgggcaaggccgacaccaagauccuguucaucgaggagggcaagaucgugcacacgagcacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcgggcacggggucaagggcugggccuucgacgacgggaacgacguguggaugggccgcaccaucaacgagaugucgcggcucggcuacgagacguucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcaccagcgggacguacggcaccggguccuggcccgacggcgccgaccugaaccugaugcccaucuga

SEQ ID NO: 26394 - RNA, 1410 nt, Artificial Sequence; identical to SEQ ID NO: 26373
  derived and/or modified CDS sequence (AUadapt) from InfluenzaA__AHC58201__NA

SEQ ID NO: 26395 - RNA, 1410 nt, Artificial Sequence
  derived and/or modified CDS sequence (AUadapt) from InfluenzaA__AHC58225__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcgggcacggggucaagggcugggccuucgacgacgggaacgacguguggaugggccgcaccaucaacgagacgucgcggcucggcuacgagaccuucaaggucaucgaggggugguccaaccccaagagcaagcugcagaucaaccgccaggugaucgugaaccggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcccaucuga

SEQ ID NO: 26396 - RNA, 1410 nt, Artificial Sequence; identical to SEQ ID NO: 26377
  derived and/or modified CDS sequence (AUadapt) from InfluenzaA__AHC58237__NA

SEQ ID NO: 26397 - RNA, 1410 nt, Artificial Sequence; identical to SEQ ID NO: 26373
  derived and/or modified CDS sequence (AUadapt) from InfluenzaA__AHC58249__NA

SEQ ID NO: 26398 - RNA, 1410 nt, Artificial Sequence; identical to SEQ ID NO: 21920
  derived and/or modified CDS sequence (AUadapt) from InfluenzaA__AHC58273__NA

SEQ ID NO: 26399 - RNA, 1410 nt, Artificial Sequence; identical to SEQ ID NO: 26377
  derived and/or modified CDS sequence (AUadapt) from InfluenzaA__AHC58363__NA

SEQ ID NO: 26400 - RNA, 1410 nt, Artificial Sequence; identical to SEQ ID NO: 25324
  derived and/or modified CDS sequence (AUadapt) from InfluenzaA__AHC58375__NA

SEQ ID NO: 26401 - RNA, 1410 nt, Artificial Sequence; identical to SEQ ID NO: 26377
  derived and/or modified CDS sequence (AUadapt) from InfluenzaA__AHC58387__NA

SEQ ID NO: 26402 - RNA, 1410 nt, Artificial Sequence; identical to SEQ ID NO: 26377
  derived and/or modified CDS sequence (AUadapt) from InfluenzaA__AHC58399__NA

SEQ ID NO: 26403 - RNA, 1410 nt, Artificial Sequence; identical to SEQ ID NO: 26373
  derived and/or modified CDS sequence (AUadapt) from InfluenzaA__AHC58411__NA

SEQ ID NO: 26404 - RNA, 1410 nt, Artificial Sequence; identical to SEQ ID NO: 25324
  derived and/or modified CDS sequence (AUadapt) from InfluenzaA__AHC58423__NA

SEQ ID NO: 26405 - RNA, 1410 nt, Artificial Sequence; identical to SEQ ID NO: 26377
  derived and/or modified CDS sequence (AUadapt) from InfluenzaA__AHC58459__NA

SEQ ID NO: 26406 - RNA, 1410 nt, Artificial Sequence
  derived and/or modified CDS sequence (AUadapt) from InfluenzaA__AHC58471__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagccggucgugucggugaagcuggccgggaacuccagccucugccccgucuccggcugggccaucuacagcaaggacaacuccauccgcaucggcagcaagggggacguguucgugauccgggagcccuucaucuccugcucgccccuggagugccgcaccuucuuccugacccagggcgcccuccugaacgacaagcacuccaacgggaccaucaaggaccggagcccguaccgcacgcugauguccugccccaucggcgagguccccagccccuacaacucccgguucgagagcguggccuggucggcguccgccugccacgacgggaucaacuggcucaccaucggcaucagcggcccggacaacggggccguggccguccugaaguacaacggcaucaucaccgacaccaucaaguccuggcgcaacaacauccugcggacgcaggagagcgagugcgcgugcgugaacggguccugcuucaccgugaugaccgacggccccagcgacggccaggccuccuacaagaucuuccgcaucgagaaggggaagaucgucaagucgguggagaugaacgcccccaacuaccacuacgaggagugcuccugcuaccccgacagcuccgagaucacgugcgugugccgggacaacuggcacggcgccaaccgcccgugggucagcuucaaccagaaccucgaguaccagaucggguacaucugcuccggcguguucggggacaacccccggcccaacgacaagaccggcagcugcggccccguguccucgaacggggccaacggcgucaagggguucuccuucaaguacggcaacgggguguggaucggccgcaccaagagcaucuccagccggaacggcuucgagaugaucugggacccgaacggguggaccggcaccgacaacaacuucagcaucaagcaggacaucguggggaucaacgagugguccggcuacucgggguccuucguccagcaccccgagcugacgggccuggacugcauccgccccugcuucuggguggagcucauccggggccgccccaaggagaacaccaucuggaccagcggguccagcaucuccuucugcggcgucaacagcgacaccguggggugguccuggccggacggcgcggagcugcccuucacgaucgacaaguga

SEQ ID NO: 26407 - RNA, 1410 nt, Artificial Sequence; identical to SEQ ID NO: 26373
  derived and/or modified CDS sequence (AUadapt) from InfluenzaA__AHC58482__NA

SEQ ID NO: 26408 - RNA, 1410 nt, Artificial Sequence; identical to SEQ ID NO: 26377
  derived and/or modified CDS sequence (AUadapt) from InfluenzaA__AHC58494__NA

SEQ ID NO: 26409 - RNA, 1410 nt, Artificial Sequence
  derived and/or modified CDS sequence (AUadapt) from InfluenzaA__AHC58518__NA
augaaccccaaccagaagaucaucaccaucggcucggugucccugaccaucagcacgaucugcuucuucaugcaggucgccauccucaucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccgucgugucgugguccaaggagauccugcggacccaggagagcgagugcgugugcaucaacggcacgugcaccgucgugaugaccgacggguccgccucgggcaaggccgacaccaagauccucuucaucgaggagggcaagaucgugcacacgagcacccuguccgggucggcgcagcacgucgaggagugcuccugcuacccccgcuaccccggcgugcggugcgugugccgcgacaacuggaaggggagcaaccggccgaucgucgacaucaacaucaaggaccacuccaucgugucguccuacgugugcagcggccuggucggcgacacgccccgcaagaacgacuccucguccagcucccacugccucgaccccaacaacgaggagggcgggcacggggugaagggcugggccuucgacgacgggaacgacgucuggaugggccggaccaucaacgagaccucgcgccugggcuacgagaccuucaaggugaucgaggggugguccaaccccaagagcaagcugcagaucaaccgccaggugaucgucgaccggggcaaccgguccggguacucgggcaucuucuccguggagggcaagagcugcaucaaccgcugcuucuacguggagcucauccgggggcgcaaggaggagaccgagguccuguggaccucgaacuccaucgugguguucugcggcacgagcgggaccuacggcaccggguccuggccggacggcgccgaccugaaccucaugcccaucuga

SEQ ID NO: 26410 - RNA, 1410 nt, Artificial Sequence; identical to SEQ ID NO: 26373
  derived and/or modified CDS sequence (AUadapt) from InfluenzaA__AHC58530__NA

SEQ ID NO: 26411 - RNA, 1410 nt, Artificial Sequence; identical to SEQ ID NO: 26373
  derived and/or modified CDS sequence (AUadapt) from InfluenzaA__AHC58554__NA

SEQ ID NO: 26412 - RNA, 1410 nt, Artificial Sequence; identical to SEQ ID NO: 26373
  derived and/or modified CDS sequence (AUadapt) from InfluenzaA__AHC58566__NA

SEQ ID NO: 26413 - RNA, 1410 nt, Artificial Sequence
  derived and/or modified CDS sequence (AUadapt) from InfluenzaA__AHC58578__NA
augaaccccaaccagaagaucaucaccaucggcucggugucccugaccgucagcacgaucugcuucuucaugcagaucgccauccucaucaccaccgugacccugcacuucaagcaguacgaguucuacuccccgcccaacaaccaggugaugcugugcgagcccacgaucaucgagcgcaacaucaccgagaucgucuaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccgucgugucgugguccaaggagauccugcgcacccaggagagcgagugcgugugcaucaacggcacgugcaccgucgugaugaccgacggguccgccucgggcaaggccgacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggucgaaccgcccgaucgucgacaucaacaucaaggaccacuccaucgugagcuccuacgugugcucgggccuggucggcgacacgccccggaagaacgacuccagcuccucgucccacugccucgaccccaacaacgaggagggcgggcacggggugaagggcugggccuucgacgacgggaacgacgucuggaugggccgcaccaucaacgagaccagccggcugggcuacgagaccuucaaggugaucgaggggugguccaaccccaagucgaagcugcagaucaaccgccaggugaucgucgaccggggcaaccgcuccggguacagcggcaucuucuccguggagggcaagucgugcaucaaccggugcuucuacguggagcucauccgcgggcggaaggaggagaccgagguccuguggaccagcaacuccaucgugguguucugcggcacgagcgggaccuacggcaccggguccuggccggacggcgccgaccugaaccucaugcccaucuga

SEQ ID NO: 26414 - RNA, 1410 nt, Artificial Sequence; identical to SEQ ID NO: 21920
  derived and/or modified CDS sequence (AUadapt) from InfluenzaA__AHC58590__NA

SEQ ID NO: 26415 - RNA, 1410 nt, Artificial Sequence; identical to SEQ ID NO: 26409
  derived and/or modified CDS sequence (AUadapt) from InfluenzaA__AHC58602__NA

SEQ ID NO: 26416 - RNA, 1410 nt, Artificial Sequence; identical to SEQ ID NO: 26373
  derived and/or modified CDS sequence (AUadapt) from InfluenzaA__AHC58614__NA

SEQ ID NO: 26417 - RNA, 1410 nt, Artificial Sequence; identical to SEQ ID NO: 26373
  derived and/or modified CDS sequence (AUadapt) from InfluenzaA__AHC58626__NA

SEQ ID NO: 26418 - RNA, 1410 nt, Artificial Sequence; identical to SEQ ID NO: 26373
  derived and/or modified CDS sequence (AUadapt) from InfluenzaA__AHC58638__NA

SEQ ID NO: 26419 - RNA, 1410 nt, Artificial Sequence; identical to SEQ ID NO: 26373
  derived and/or modified CDS sequence (AUadapt) from InfluenzaA__AHC58650__NA

SEQ ID NO: 26420 - RNA, 1410 nt, Artificial Sequence
  derived and/or modified CDS sequence (AUadapt) from InfluenzaA__AHC58662__NA
augaaccccaaccagaagaucaucaccaucggcucggugucccugaccaucucgacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggucguccagcuccugccacgacgggaaggccuggcuccacgugugcaucaccggcgacgacaagaacgcgaccgccucguucaucuacaacgggaagcugguggacuccguggucagcugguccaaggagauccugcggacgcaggagucggagugcgugugcaucaacgggaccugcaccguggucaugaccgacggguccgccagcggcaaggccgacacgaagauccucuucaucgaggagggcaagaucgugcacaccucgacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcggccacggggucaagggcugggccuucgacgacgggaacgacguguggaugggccggaccaucaacgagaccucgcgccugggcuacgagaccuucaaggucaucgaggggugguccaaccccaagagcaagcugcagaucaaccgccaggugaucguggaccggggcaaccgguccggguacucgggcaucuucuccgucgagggcaagagcugcaucaaccgcugcuucuacguggagcucauccgggggcgcaaggaggagaccgaggugcuguggacgucgaacuccaucgucguguucugcggcaccagcgggaccuacggcaccggguccuggccggacggcgccgaccugaaccucaugcccaucuga

SEQ ID NO: 26421 - RNA, 1410 nt, Artificial Sequence
  derived and/or modified CDS sequence (AUadapt) from InfluenzaA__AHC58686__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccagguggugcugugcgagcccacgaucaucgagcgcaacaucaccgagaucgucuaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggugacccgggagcccuacgugagcugcgacccggacaagugcuaccaguucgcccugggccaggggaccacgcucaacaacguccacuccaacaacaccgugcgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccgucgugagcugguccaaggagauccugcgcacccaggagucggagugcgugugcaucaacggcacgugcaccgucgugaugaccgacggguccgccagcggcaaggccgacaccaagauccuguucaucgaggagggcaagaucgugcacacgucgacccucuccgggucggcgcagcacgucgaggagugcuccugcuacccccgguacccgggcgugcgcugcgugugccgggacaacuggaaggggagcaaccgccccaucgucgacaucaacaucaaggaccacuccaucgugucguccuacgugugcagcggccuggucggcgacaccccgcggaagaacgacuccucguccagcucccacugccuggaccccaacaacgaggagggcgggcacggggugaagggcugggccuucgacgacgggaacgacgucuggaugggccgcaccaucaacgagacgucgcggcucggcuacgagaccuucaaggugaucgaggggugguccaaccccaagagcaagcugcagaucaaccgccaggugaucgucgaccggggcgaccgcuccggguacucgggcaucuucuccguggagggcaagagcugcaucaaccggugcuucuacguggagcugauccgcgggcggaaggaggagaccgagguccucuggaccucgaacuccaucgugguguucugcggcacgagcgggaccuacggcaccggguccuggcccgacggcgccgaccugaaccugaugcccaucuga

SEQ ID NO: 26422 - RNA, 1410 nt, Artificial Sequence
  derived and/or modified CDS sequence (AUadapt) from InfluenzaA__AHC58698__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcgccguggucaugaccgacggguccgccucgggcaaggcggacaccaagauccucuucaucgaggagggcaagaucgugcacaccagcacgcuguccgggucggcccagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggaccggggcaaccgcuccggguacucgggcaucuucuccgucgagggcaagagcugcaucaaccggugcuucuacguggagcucauccgcgggcggaaggaggagaccgaggugcuguggaccucgaacuccaucgucguguucugcggcaccagcgggacguacggcaccggguccuggccggacggcgccgaccugaaccucaugcccaucuga

SEQ ID NO: 26423 - RNA, 1410 nt, Artificial Sequence; identical to SEQ ID NO: 25324
  derived and/or modified CDS sequence (AUadapt) from InfluenzaA__AHC58710__NA

SEQ ID NO: 26424 - RNA, 1410 nt, Artificial Sequence; identical to SEQ ID NO: 25324
  derived and/or modified CDS sequence (AUadapt) from InfluenzaA__AHC58722__NA

SEQ ID NO: 26425 - RNA, 1410 nt, Artificial Sequence
  derived and/or modified CDS sequence (AUadapt) from InfluenzaA__AHC58734__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcauccggugcgucugccgcgacaacuggaaggggagcaaccggccgaucguggacaucaacaucaaggaccacuccaucgugucguccuacgucugcagcggccuggugggcgacacgccccgcaagaacgacuccucguccagcucccacugccucgaccccaacaacgaggagggcgggcacggggugaagggcugggccuucgacgacgggaacgacgucuggaugggccggaccaucaacgagaccucgcgccugggcuacgagaccuucaaggugaucgaggggugguccaaccccaagagcaagcugcagaucaaccggcaggucaucguggaccgcggcaaccgguccggguacucgggcaucuucuccguggagggcaagagcugcaucaaccgcugcuucuacgucgagcucauccgggggcgcaaggaggagaccgaggugcuguggaccucgaacuccaucguggucuucugcggcacgagcgggaccuacggcaccggguccuggccggacggcgccgaccugaaccucaugcccaucuga

SEQ ID NO: 26426 - RNA, 1410 nt, Artificial Sequence; identical to SEQ ID NO: 26373
  derived and/or modified CDS sequence (AUadapt) from InfluenzaA__AHC58746__NA

SEQ ID NO: 26427 - RNA, 1410 nt, Artificial Sequence; identical to SEQ ID NO: 26377
  derived and/or modified CDS sequence (AUadapt) from InfluenzaA__AHC58758__NA

SEQ ID NO: 26428 - RNA, 1410 nt, Artificial Sequence; identical to SEQ ID NO: 26373
  derived and/or modified CDS sequence (AUadapt) from InfluenzaA__AHC58770__NA

SEQ ID NO: 26429 - RNA, 1410 nt, Artificial Sequence; identical to SEQ ID NO: 21920
  derived and/or modified CDS sequence (AUadapt) from InfluenzaA__AHC58782__NA

SEQ ID NO: 26430 - RNA, 1410 nt, Artificial Sequence; identical to SEQ ID NO: 26373
  derived and/or modified CDS sequence (AUadapt) from InfluenzaA__AHC58806__NA

SEQ ID NO: 26431 - RNA, 1410 nt, Artificial Sequence
  derived and/or modified CDS sequence (AUadapt) from InfluenzaA__AHC58818__NA
augaaccccaaccagaagaucaucaccaucggcucggugucccugaccaucagcacgaucugcuucuucauccagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggaccggggcaaccgcuccggguacucgggcaucuucuccgucgagggcaagagcugcaucaaccggugcuucuacguggagcucauccgcgggcggaaggaggagaccgaggugcuguggaccucgaacuccaucgucguguucugcggcacgagcgggaccuacggcaccggguccuggccggacggcgccgaccugaaccucaugcccaucuga

SEQ ID NO: 26432 - RNA, 1410 nt, Artificial Sequence; identical to SEQ ID NO: 26422
  derived and/or modified CDS sequence (AUadapt) from InfluenzaA__AHC58830__NA

SEQ ID NO: 26433 - RNA, 1410 nt, Artificial Sequence; identical to SEQ ID NO: 26373
  derived and/or modified CDS sequence (AUadapt) from InfluenzaA__AHC58842__NA

SEQ ID NO: 26434 - RNA, 1410 nt, Artificial Sequence
  derived and/or modified CDS sequence (AUadapt) from InfluenzaA__AHC58866__NA
augaaccccaaccagaagaucaucaccaucggcucggugucccugaccaucagcacgaucugcuucuucaugcagaucgccauccucaucaccaccgucacccugcacuucaagcagugcgaguucaacuccccgcccaacaaccgcgugaugcugugcgagcccacgaucaucgagcggaacaucaccgagaucguguaccucaccaacaccacgaucgagaaggagaucugccccaagcuggccgaguaccgcaacuggucgaagccgcagugcgacaucaccggguucgcgcccuucuccaaggacaacagcauccggcuguccgccggcggggacaucugggucacccgcgagcccuacgugucgugcgaccccaacaagugcuaccaguucgcccucggccaggggaccacgcugaacaacgugcacuccaacaacaccguccgggaccgcaccccguaccggacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggaccggggcaaccgcuccggguacucgggcaucuucuccgucgagggcaagagcugcaucaaccggugcuucuacguggagcucauccgcgggcggaaggaggagaccggcgugcuguggaccucgaacuccaucgucguguucugcgggacgagcggcaccuacgggaccggcuccuggccggacggggccgaccugaaccucaugcccaucuga

SEQ ID NO: 26435 - RNA, 1410 nt, Artificial Sequence; identical to SEQ ID NO: 26422
  derived and/or modified CDS sequence (AUadapt) from InfluenzaA__AHC58878__NA

SEQ ID NO: 26436 - RNA, 1410 nt, Artificial Sequence; identical to SEQ ID NO: 26373
  derived and/or modified CDS sequence (AUadapt) from InfluenzaA__AHC58890__NA

SEQ ID NO: 26437 - RNA, 1410 nt, Artificial Sequence; identical to SEQ ID NO: 26377
  derived and/or modified CDS sequence (AUadapt) from InfluenzaA__AHC58902__NA

SEQ ID NO: 26438 - RNA, 1410 nt, Artificial Sequence; identical to SEQ ID NO: 26373
  derived and/or modified CDS sequence (AUadapt) from InfluenzaA__AHC58996__NA

SEQ ID NO: 26439 - RNA, 1410 nt, Artificial Sequence; identical to SEQ ID NO: 26373
  derived and/or modified CDS sequence (AUadapt) from InfluenzaA__AHC59008__NA

SEQ ID NO: 26440 - RNA, 1410 nt, Artificial Sequence; identical to SEQ ID NO: 26377
  derived and/or modified CDS sequence (AUadapt) from InfluenzaA__AHC59020__NA

SEQ ID NO: 26441 - RNA, 1410 nt, Artificial Sequence
  derived and/or modified CDS sequence (AUadapt) from InfluenzaA__AHC59032__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccagcguccggugcgugugccgcgacaacuggaagggcuccaaccggccgaucguggacaucaacaucaaggaccacucgaucgucuccagcuacgugugcuccgggcuggugggcgacacgccccgcaagaacgacucguccagcuccucgcacugccucgaccccaacaacgaggagggcgggcacggcgucaaggggugggccuucgacgacggcaacgacguguggauggggcggaccaucaacgagaccucccgccugggcuacgagaccuucaaggucaucgagggcuggagcaaccccaaguccaagcugcagaucaaccgccaggugaucguggaccgggggaaccggucgggcuacuccgggaucuucagcgucgagggcaagucgugcaucaaccgcugcuucuacguggagcucauccgggggcgcaaggaggagaccgaggugcuguggaccuccaacagcaucgucguguucugcggcacguccggcaccuacgggaccggcagcuggccggacggggccgaccugaaccucaugcccaucuga

SEQ ID NO: 26442 - RNA, 1410 nt, Artificial Sequence; identical to SEQ ID NO: 26409
  derived and/or modified CDS sequence (AUadapt) from InfluenzaA__AHC59044__NA

SEQ ID NO: 26443 - RNA, 1410 nt, Artificial Sequence; identical to SEQ ID NO: 21920
  derived and/or modified CDS sequence (AUadapt) from InfluenzaA__AHC59056__NA

SEQ ID NO: 26444 - RNA, 1410 nt, Artificial Sequence; identical to SEQ ID NO: 26373
  derived and/or modified CDS sequence (AUadapt) from InfluenzaA__AHC59068__NA

SEQ ID NO: 26445 - RNA, 1410 nt, Artificial Sequence; identical to SEQ ID NO: 26373
  derived and/or modified CDS sequence (AUadapt) from InfluenzaA__AHC59080__NA

SEQ ID NO: 26446 - RNA, 1410 nt, Artificial Sequence
  derived and/or modified CDS sequence (AUadapt) from InfluenzaA__AHC59092__NA
augaaccccaaccagaagaucaucaccaucggcucggugucccugaccaucucgacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggugacccgggagcccuacgugagcugcgacccggacaagugcuaccaguucgcccugggccaggggaccacgcucaacaacguccacuccaacaacaccgugcgcgaccggacccccuaccgcacccugcugaugaacgagcucggcgugcccuuccaccugggcacgaagcaggucugcaucgccuggucguccucguccugccacgacgggaaggccuggcugcacgugugcaucaccggcgacgacaagaacgcgaccgccagcuucaucuacaacgggcggcucguggacuccgucgugucgugguccaaggagauccugcgcacccaggagagcgagugcgugugcaucaacggcacgugcaccgucgugaugaccgacggguccgccucgggcaaggccgacaccaagauccuguucaucgaggagggcaagaucgugcacacgagcacccucuccgggucggcgcagcacgucgaggagugcuccugcuacccccgguacccgggcgugcgcugcgugugccgggacaacuggaaggggucgaaccgccccaucgucgacaucaacaucaaggaccacuccaucgugagcuccuacgugugcucgggccuggucggcgacacgccccggaagaacgacuccagcuccucggggcacugccuggaccccaacaacgaggagggcgggcacggcgugaaggggugggccuucgacgacggcaacgacgucuggaugggccgcaccaucaacgagaccucccggcucggguacgagaccuucaaggugaucgagggcuggucgaacccgaaguccaagcugcagaucaaccgccaggugaucgucgaccgcggggaccggagcggcuacuccgggaucuucucgguggagggcaaguccugcaucaaccggugcuucuacguggagcugauccgcggccggaaggaggagaccgagguccucuggaccagcaacucgaucgugguguucugcgggacguccggcaccuacgggaccggcagcuggcccgacggggccgaccugaaccugaugcccaucuga

SEQ ID NO: 26447 - RNA, 1410 nt, Artificial Sequence
  derived and/or modified CDS sequence (AUadapt) from InfluenzaA__AHC59104__NA
augaaccccaaccagaagaucaucaccaucggcucggugucccugaccaucagcacgaucugcuucuucaugcagaucgccauccucaucaccaccgucacccugcacuucaagcaguacgaguucuacuccccgcccaacaaccaggugaugcugugcgagcccacgaucaucaagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccucgucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagucgaagcugcagaucaaccgccaggugaucguggaccggggcaaccgcuccggguacagcggcaucuucuccgucgagggcaagucgugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 26448 - RNA, 1410 nt, Artificial Sequence
  derived and/or modified CDS sequence (AUadapt) from InfluenzaA__AHC59116__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcugcagaucaaccgccaggugaucguggaccggggcaaccgguccggguacucgggcaucuucuccgucgagggcaagagcugcaucaaccgcugcuucuacguggagcucauccgggggcgcgaggaggagaccgaggugcuguggaccucgaacuccaucgucguguucugcggcacgagcgggaccuacggcaccggguccuggccggacggcgccgaccugaaccucaugcccaucuga

SEQ ID NO: 26449 - RNA, 1410 nt, Artificial Sequence
  derived and/or modified CDS sequence (AUadapt) from InfluenzaA__AHC59128__NA
augaaccccaaccagaagaucaucaccaucggcucggugucccugaccaucagcacgaucugcuucuucaugcagaucgccauccucaucaccaccgucacccugcacuucaagcaguacgaguucuacuccccgcccaacaaccaggugaugcugugcgagcccacgaucauggagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcggcugguggacuccgucgugucgugguccaaggagauccugcgcacccaggagagcgagugcgugugcaucaacggcacgugcaccgucgugaugaccgacggguccgccucgggcaaggccgacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggucgaaccgcccgaucgucgacaucaacaucaaggaccacuccaucgugagcuccuacgugugcucgggccuggucggcgacacgccccggaagaacgacuccagcuccucgucccacugccucgaccccaacaacgaggagggcgggcacggggugaagggcugggccuucgacgacgggaacgacgucuggaugggccgcaccaucaacgagaccagccggcugggcuacgagaccuucaaggugaucgaggggugguccaaccccaagucgaagcugcagaucaaccgccaggugaucgucgaccggggcaaccgcuccggguacagcggcaucuucuccguggagggcaagucgugcaucaaccggugcuucuacguggagcucauccgcgggcggaaggaggagaccgagguccuguggaccagcaacuccaucgugguguucugcggcacgagcgggaccuacggcaccggguccuggccggacggcgccgaccugaaccucaugcccaucuga

SEQ ID NO: 26450 - RNA, 1410 nt, Artificial Sequence
  derived and/or modified CDS sequence (AUadapt) from InfluenzaA__AHC59152__NA
augaaccccaaccagaagaucaucaccaucggcucggugucccugaccaucagcacgaucugcuucuucaugcaggucgccauccucaucaccaccgugacccugcacuucaagcaguacgaguucaacuccccgcccaacaaccaggugaugcugugcgagcccacgaucaucgagcgcaacaucaccgagauccucuaccugaccaacaccacgaucgagaaggagaucugccccaagcuggccgaguaccggaacuggucgaagccgcagugcgacaucaccggguucgcgcccuucuccaaggacaacagcauccgccucuccgccggcggggacaucugggucacccgggagcccuacgugucgugcgaccccgacaagugcuaccaguucgcccugggccaggggaccacgcugaacaacgugcacuccaacaacaccguccgcgaccggaccccguaccgcacccuccugaugaacgagcugggcgugcccuuccaccucggcacgaagcaggucugcaucgccuggagcuccucguccugccacgacgggaaggccuggcugcacgugugcaucaccggcgacgacaagaacgcgaccgccagcuucaucuacaacgggaagcugguggacuccguggucucgugguccaaggagauccuccggacccaggagagcgagugcgugugcaucaacggcacgugcaccguggucaugaccgacggguccgccucgggcaaggccgacaccaagauccuguucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccucgugggcgacacgccccgcaagaacgacuccucguccagcucccacugccuggaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcuccagaucaaccgccaggugaucguggaccggggcaaccgguccggguacucgggcaucuucuccgucgagggcaagagcugcaucaaccgcugcuucuacguggagcugauccgggggcgcaaggaggagaccgaggugcuguggaccucgaacuccaucgucguguucugcggcacgagcgggaccuacggcaccggguccuggccggacggcgccgaccucaaccugaugcccaucuga

SEQ ID NO: 26451 - RNA, 1410 nt, Artificial Sequence
  derived and/or modified CDS sequence (AUadapt) from InfluenzaA__AHC59188__NA
augaaccccaaccagaagaucaucaccaucggcucggugucccugaccaucucgacgaucugcuucuucaugcagaucgccauccucaucaccaccgucacccugcacuucaagcaguacgaguucaacccgccgcccaacaaccagguggugcugugcgagcccacgaucaucgagcgcaacaucaccgagaucgucuaccucaccaacaccacgaucgagaaggagaucugccccaagcuggccgaguaccggaacugguccaagccccagugcgacaucaccggguucgcgcccuucagcaaggacaacuccauccgccugucggccggcggggacaucugggugacccgggagcccuacguguccugcgacccggacaagugcuaccaguucgcccucggccaggggaccacgcugaacaacguccacagcaacaacaccgugcgcgaccggacccccuaccgcacccugcucaugaacgagcugggcgugcccuuccaccugggcacgaagcaggucugcaucgccugguccucguccagcugccacgacgggaaggccuggcuccacgugugcaucaccggcgacgacaagaacgcgaccgccuccuucaucuacaacgggcggcugguggacucggucguguccuggagcaaggagauccugcgcacccaggaguccgagugcgugugcaucaacggcacgugcaccgucgugaugaccgacgggucggccuccggcaaggccgacaccaagauccucuucaucgaggagggcaagaucgugcacacgagcacccugucgggguccgcgcagcacgucgaggagugcucgugcuacccccgguacccgggcgugcgcugcgugugccgggacaacuggaagggguccaaccgccccaucgucgacaucaacaucaaggaccacagcaucguguccucguacgugugcuccggccuggucggcgacacgccccggaagaacgacagcuccucguccagccacugccucgaccccaacaacgaggagggcgggcacggggugaagggcugggccuucgacgacgggaacgacgucuggaugggccgcaccaucaacgagaccucccggcugggcuacgagaccuucaaggugaucgagggguggucgaacccgaaguccaagcugcagaucaaccgccaggugaucgucgaccggggcgaccgcagcggguacuccggcaucuucucgguggaggggaaguccugcaucaaccggugcuucuacguggagcucauccgcggccggaaggaggagaccgagguccuguggaccagcaacucgaucgugguguucugcggcacguccgggaccuacggcaccgggagcuggcccgacggcgccgaccugaaccucaugcccaucuga

SEQ ID NO: 26452 - RNA, 1410 nt, Artificial Sequence; identical to SEQ ID NO: 21920
  derived and/or modified CDS sequence (AUadapt) from InfluenzaA__AHC59200__NA

SEQ ID NO: 26453 - RNA, 1410 nt, Artificial Sequence
  derived and/or modified CDS sequence (AUadapt) from InfluenzaA__AHC59212__NA
augaaccccaaccagaagaucaucaccaucggcucggugucccugaccaucucgacgaucugcuucuucaugcagaucgccacccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacgcaggagucggagugcgugugcaucaacgggaccugcaccguggucaugaccgacggguccgccagcggcaaggccgacacgaagauccucuucaucgaggagggcaagaucgugcacaccucgacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcggccacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcucauccgcgggcggaaggaggagaccgaggugcuguggacgucgaacuccaucgucguguucugcggcaccagcgggaccuacggcaccggguccuggccggacggcgccgaccugaaccucaugcccaucuga

SEQ ID NO: 26454 - RNA, 1410 nt, Artificial Sequence; identical to SEQ ID NO: 26377
  derived and/or modified CDS sequence (AUadapt) from InfluenzaA__AHC59224__NA

SEQ ID NO: 26455 - RNA, 1410 nt, Artificial Sequence
  derived and/or modified CDS sequence (AUadapt) from InfluenzaA__AHC59236__NA
augaaccccaaccagaagaucaucaccaucggcucggugucccugaccaucagcacgaucugcuucuucaugcagaucgccauccucaucaccaccgucacccugcacuucaagcaguacgaguucuacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccacgaccgcaccccguaccggacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcgccugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggucgaaccggccgaucguggacaucaacaucaaggaccacuccaucgucagcuccuacgugugcucgggccuggugggcgacacgccccgcaagaacgacuccagcuccucgucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagucgaagcugcagaucaaccgccaggugaucguggaccggggcaaccgguccggguacagcggcaucuucuccgucgagggcaagucgugcaucaaccgcugcuucuacguggagcucauccgggggcgcaaggaggagaccgaggugcuguggaccagcaacuccaucgucguguucugcggcacgagcgggaccuacggcaccggguccuggccggacggcgccgaccugaaccucaugcccaucuga

SEQ ID NO: 26456 - RNA, 1410 nt, Artificial Sequence; identical to SEQ ID NO: 26377
  derived and/or modified CDS sequence (AUadapt) from InfluenzaA__AHC59260__NA

SEQ ID NO: 26457 - RNA, 1410 nt, Artificial Sequence; identical to SEQ ID NO: 26373
  derived and/or modified CDS sequence (AUadapt) from InfluenzaA__AHC59272__NA

SEQ ID NO: 26458 - RNA, 1410 nt, Artificial Sequence; identical to SEQ ID NO: 26377
  derived and/or modified CDS sequence (AUadapt) from InfluenzaA__AHC59284__NA

SEQ ID NO: 26459 - RNA, 1410 nt, Artificial Sequence
  derived and/or modified CDS sequence (AUadapt) from InfluenzaA__AHC59296__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaagaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcugcagaucaaccgccaggugaucguggaccggggcaaccgguccggguacucgggcaucuucuccgucgagggcaagagcugcaucaaccgcugcuucuacguggagcucauccgggggcgcaaggaggagaccgaggugcuguggaccucgaacuccaucgucguguucugcggcacgagcgggaccuacggcaccggguccuggccggacggcgccgaccugaaccucaugcccaucuga

SEQ ID NO: 26460 - RNA, 1410 nt, Artificial Sequence
  derived and/or modified CDS sequence (AUadapt) from InfluenzaA__AHC59308__NA
augaaccccaaccagaagaucaucaccaucggcucggugucccugaccaucucgacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgcccuucagcaaggacaacuccauccgccugucggccggcggggacaucugggucacccgggagcccuacguguccugcgacccgaacaagugcuaccaguucgcccucggccaggggaccacgcugaacaacgugcacagcaacaacaccguccgcgaccggacccccuaccgcacccugcucaugaacgagcugggcgugcccuuccaccugggcacgaagcaggucugcaucgccugguccucguccagcugccacgacgggaaggccuggcuccacgugugcaucaccggcgacgacaagaacgcgaccgccuccuucaucuacaacgggaagcugguggacucgguggucuccuggagcaaggagauccugcggacccaggaguccgagugcgugugcaucaacggcacgugcaccguggucaugaccgacgggucggccuccggcaaggccgacaccaagauccucuucaucgaggagggcaagaucgugcacacgagcacccugucgggguccgcgcagcacguggaggagugcucgugcuacccccgcuacccgggcguccggugcgugugccgcgacaacuggaagggguccaaccggcccaucguggacaucaacaucaaggaccacagcaucgucuccucguacgugugcuccggccuggugggcgacacgccccgcaagaacgacagcuccucguccagccacugccucgaccccaacaacgaggagggcgggcacggggucaagggcugggccuucgacgacgggaacgacguguggaugggccggaccaucaacgagaccucccgccugggcuacgagaccuucaaggucaucgagggguggucgaacccgaaguccaagcugcagaucaaccgccaggugaugguggaccggggcaaccggagcggguacuccggcaucuucucggucgaggggaaguccugcaucaaccgcugcuucuacguggagcucauccggggccgcaaggaggagaccgaggugcuguggaccagcaacucgaucgucguguucugcggcacguccgggaccuacggcaccgggagcuggcccgacggcgccgaccugaaccucaugcccaucuga

SEQ ID NO: 26461 - RNA, 1410 nt, Artificial Sequence; identical to SEQ ID NO: 26285
  derived and/or modified CDS sequence (AUadapt) from InfluenzaA__AHC59320__NA

SEQ ID NO: 26462 - RNA, 1410 nt, Artificial Sequence; identical to SEQ ID NO: 16339
  derived and/or modified CDS sequence (AUadapt) from InfluenzaA__AHC59332__NA

SEQ ID NO: 26463 - RNA, 1410 nt, Artificial Sequence; identical to SEQ ID NO: 26421
  derived and/or modified CDS sequence (AUadapt) from InfluenzaA__AHC59344__NA

SEQ ID NO: 26464 - RNA, 1410 nt, Artificial Sequence
  derived and/or modified CDS sequence (AUadapt) from InfluenzaA__AHC59368__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucgacgagaccucgcgccugggcuacgagaccuucaaggucaucgaggggugguccaaccccaagagcaagcugcagaucaaccgccaggugaucguggaccggggcaaccgguccggguacucgggcaucuucuccgucgagggcaagagcugcaucaaccgcugcuucuacguggagcucauccgggggcgcaaggaggagaccgaggugcuguggaccucgaacuccaucgucguguucugcggcacgagcgggaccuacggcaccggguccuggccggacggcgccgaccugaaccucaugcccaucuga

SEQ ID NO: 26465 - RNA, 1410 nt, Artificial Sequence; identical to SEQ ID NO: 26373
  derived and/or modified CDS sequence (AUadapt) from InfluenzaA__AHC59380__NA

SEQ ID NO: 26466 - RNA, 1410 nt, Artificial Sequence; identical to SEQ ID NO: 25324
  derived and/or modified CDS sequence (AUadapt) from InfluenzaA__AHC59392__NA

SEQ ID NO: 26467 - RNA, 1410 nt, Artificial Sequence; identical to SEQ ID NO: 26409
  derived and/or modified CDS sequence (AUadapt) from InfluenzaA__AHC59404__NA

SEQ ID NO: 26468 - RNA, 1410 nt, Artificial Sequence; identical to SEQ ID NO: 26377
  derived and/or modified CDS sequence (AUadapt) from InfluenzaA__AHC59416__NA

SEQ ID NO: 26469 - RNA, 1410 nt, Artificial Sequence
  derived and/or modified CDS sequence (AUadapt) from InfluenzaA__AHC59428__NA
augaaccccaaccagaagaucaucaccaucggcucggugucccugaccaucagcacgaucugcuucuucaugcagaucgccauccucaucaccaccgucacccugcacuucaagcaguacgaguucuacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgaccgcugcuaccaguucgcccucggccaggggaccacgcugaacaacgugcacuccaacaacaccguccgggaccgcaccccguaccggacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcgccugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggucgaaccggccgaucguggacaucaacaucaaggaccacuccaucgucagcuccuacgugugcucgggccuggugggcgacacgccccgcaagaacgacuccagcuccucgucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagucgaagcugcagaucaaccgccaggugaucguggaccggggcaaccgguccggguacagcggcaucuucuccgucgagggcaagucgugcaucaaccgcugcuucuacguggagcucauccgggggcgcaaggaggagaccgaggugcuguggaccagcaacuccaucgucguguucugcggcacgagcgggaccuacggcaccggguccuggccggacggcgccgaccugaaccucaugcccaucuga

SEQ ID NO: 26470 - RNA, 1410 nt, Artificial Sequence
  derived and/or modified CDS sequence (AUadapt) from InfluenzaA__AHC59440__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcagacgucgacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcgggcacggggucaagggcugggccuucgacgacgggaacgacguguggaugggccgcaccaucaacgagacgucgcggcucggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcccaucuga

SEQ ID NO: 26471 - RNA, 1410 nt, Artificial Sequence; identical to SEQ ID NO: 26377
  derived and/or modified CDS sequence (AUadapt) from InfluenzaA__AHC59452__NA

SEQ ID NO: 26472 - RNA, 1410 nt, Artificial Sequence; identical to SEQ ID NO: 21920
  derived and/or modified CDS sequence (AUadapt) from InfluenzaA__AHC59464__NA

SEQ ID NO: 26473 - RNA, 1410 nt, Artificial Sequence; identical to SEQ ID NO: 26285
  derived and/or modified CDS sequence (AUadapt) from InfluenzaA__AHC59476__NA

SEQ ID NO: 26474 - RNA, 1410 nt, Artificial Sequence; identical to SEQ ID NO: 26377
  derived and/or modified CDS sequence (AUadapt) from InfluenzaA__AHC59488__NA

SEQ ID NO: 26475 - RNA, 1410 nt, Artificial Sequence; identical to SEQ ID NO: 26377
  derived and/or modified CDS sequence (AUadapt) from InfluenzaA__AHC59500__NA

SEQ ID NO: 26476 - RNA, 1410 nt, Artificial Sequence; identical to SEQ ID NO: 26422
  derived and/or modified CDS sequence (AUadapt) from InfluenzaA__AHC59512__NA

SEQ ID NO: 26477 - RNA, 1410 nt, Artificial Sequence; identical to SEQ ID NO: 26422
  derived and/or modified CDS sequence (AUadapt) from InfluenzaA__AHC59524__NA

SEQ ID NO: 26478 - RNA, 1410 nt, Artificial Sequence; identical to SEQ ID NO: 26409
  derived and/or modified CDS sequence (AUadapt) from InfluenzaA__AHC59536__NA

SEQ ID NO: 26479 - RNA, 1410 nt, Artificial Sequence; identical to SEQ ID NO: 26377
  derived and/or modified CDS sequence (AUadapt) from InfluenzaA__AHC59548__NA

SEQ ID NO: 26480 - RNA, 1410 nt, Artificial Sequence; identical to SEQ ID NO: 26377
  derived and/or modified CDS sequence (AUadapt) from InfluenzaA__AHC59560__NA

SEQ ID NO: 26481 - RNA, 1410 nt, Artificial Sequence; identical to SEQ ID NO: 26455
  derived and/or modified CDS sequence (AUadapt) from InfluenzaA__AHC59572__NA

SEQ ID NO: 26482 - RNA, 1410 nt, Artificial Sequence; identical to SEQ ID NO: 26450
  derived and/or modified CDS sequence (AUadapt) from InfluenzaA__AHC59584__NA

SEQ ID NO: 26483 - RNA, 1410 nt, Artificial Sequence; identical to SEQ ID NO: 26422
  derived and/or modified CDS sequence (AUadapt) from InfluenzaA__AHC59596__NA

SEQ ID NO: 26484 - RNA, 1410 nt, Artificial Sequence; identical to SEQ ID NO: 25324
  derived and/or modified CDS sequence (AUadapt) from InfluenzaA__AHC59608__NA

SEQ ID NO: 26485 - RNA, 1410 nt, Artificial Sequence; identical to SEQ ID NO: 26409
  derived and/or modified CDS sequence (AUadapt) from InfluenzaA__AHC59620__NA

SEQ ID NO: 26486 - RNA, 1410 nt, Artificial Sequence; identical to SEQ ID NO: 26377
  derived and/or modified CDS sequence (AUadapt) from InfluenzaA__AHC59632__NA

SEQ ID NO: 26487 - RNA, 1410 nt, Artificial Sequence; identical to SEQ ID NO: 26377
  derived and/or modified CDS sequence (AUadapt) from InfluenzaA__AHC59644__NA

SEQ ID NO: 26488 - RNA, 1410 nt, Artificial Sequence
  derived and/or modified CDS sequence (AUadapt) from InfluenzaA__AHC59656__NA
augaaccccaaccagaagaucaucaccaucggcucggugucccugaccaucagcacgaucugcuucuucaugcagaucgccauccucaucaccaccgucaccaugcacuucaagcaguacgaguucaacuccccgcccaacaaccaggugaugcugugcgagcccacgaucaucgagcgcaacaucaccgagaucguguaccugaccaacaccacgaucgagaaggagaucugccccaagcucgccgaguaccggaacuggucgaagccgcagugcgacaucaccggguucgcgcccuucuccaaggacaacagcauccgccuguccgccggcggggacaucugggucacccgggagcccuacgugucgugcgaccccgugaagugcuaccaguucgcccugggccaggggaccacgcucaacaacguccacuccaacaacaccgugcgcgaccggaccccguaccgcacccugcugaugaacgagcucggcgugcccuuccaccugggcacgaagcaggucugcaucgccuggagcuccucguccugccacgacgggaaggccuggcugcacgugugcaucaccggcgacgacaagaacgcgaccgccagcuucaucuacaacgggaagcucguggacuccgucgugucgugguccaaggagauccugcggacccaggagagcgagugcgugugcaucaacggcacgugcaccgucgugaugaccgacggguccgccucgggcaaggccgacaccaagauccuguucaucgaggagggcaagaucgugcacacgagcacccucuccgggagcgcgcagcacgucgaggagugcuccugcuacccccgcuaccccggcgugcggugcgugugccgcgacaacuggaaggggucgaaccggccgaucgucgacaucaacaucaaggaccacuccaucgugagcuccuacgugugcucgggccuggucggcgacacgccccgcaagaacgacuccagcuccucgucccacugccuggaccccaacaacgaggagggcgggcacggggugaagggcugggccuucgacgacgggaacgacgucuggaugggccggaccaucaacgagaccagccgccucggcuacgagaccuucaaggugaucgaggggugguccaaccccaagucgaagcugcagaucaaccgccaggugaucgucgaccggggcaaccgguccggguacagcggcaucuucuccguggagggcaagucgugcaucaaccgcugcuucuacguggagcugauccgggggcgcaaggaggagaccgagguccucuggaccagcaacuccaucgugguguucugcggcacgagcgggaccuacggcaccggguccuggccggacggcgccgaccugaaccugaugcccaucuga

SEQ ID NO: 26489 - RNA, 1410 nt, Artificial Sequence; identical to SEQ ID NO: 26422
  derived and/or modified CDS sequence (AUadapt) from InfluenzaA__AHC59668__NA

SEQ ID NO: 26490 - RNA, 1410 nt, Artificial Sequence; identical to SEQ ID NO: 26450
  derived and/or modified CDS sequence (AUadapt) from InfluenzaA__AHC59680__NA

SEQ ID NO: 26491 - RNA, 1410 nt, Artificial Sequence; identical to SEQ ID NO: 26377
  derived and/or modified CDS sequence (AUadapt) from InfluenzaA__AHC59704__NA

SEQ ID NO: 26492 - RNA, 1410 nt, Artificial Sequence; identical to SEQ ID NO: 21920
  derived and/or modified CDS sequence (AUadapt) from InfluenzaA__AHC59716__NA

SEQ ID NO: 26493 - RNA, 1410 nt, Artificial Sequence; identical to SEQ ID NO: 21920
  derived and/or modified CDS sequence (AUadapt) from InfluenzaA__AHC59728__NA

SEQ ID NO: 26494 - RNA, 1410 nt, Artificial Sequence; identical to SEQ ID NO: 26422
  derived and/or modified CDS sequence (AUadapt) from InfluenzaA__AHC59752__NA

SEQ ID NO: 26495 - RNA, 1410 nt, Artificial Sequence; identical to SEQ ID NO: 26409
  derived and/or modified CDS sequence (AUadapt) from InfluenzaA__AHC59764__NA

SEQ ID NO: 26496 - RNA, 1410 nt, Artificial Sequence
  derived and/or modified CDS sequence (AUadapt) from InfluenzaA__AHC59776__NA
augaaccccaaccagaagaucaucaccaucggcucggugucccugaccaucagcacgaucugcuucuucaugcagaucgccauccucaucaccaccgucacccugcacuucaagcaguacgaguucuacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggucgaaccggccgaucguggacaucaacaucaaggaccacuccaucgucagcuccuacgugugcucgggccuggugggcgacacgccccgcaagaacgacuccagcuccucgucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagucgaagcugcagaucaaccgccaggugaucguggaccggggcaaccgguccggguacagcggcaucuucuccgucgagggcaagucgugcaucaaccgcugcuucuacguggagcucauccgggggcgcaaggaggagaccgaggugcuguggaccagcaacuccaucgucguguucugcggcacgagcgggaccuacggcaccggguccuggccggacggcgccgaccugaaccucaugcccaucuga

SEQ ID NO: 26497 - RNA, 1410 nt, Artificial Sequence; identical to SEQ ID NO: 26373
  derived and/or modified CDS sequence (AUadapt) from InfluenzaA__AHC59788__NA

SEQ ID NO: 26498 - RNA, 1410 nt, Artificial Sequence; identical to SEQ ID NO: 26450
  derived and/or modified CDS sequence (AUadapt) from InfluenzaA__AHC59800__NA

SEQ ID NO: 26499 - RNA, 1410 nt, Artificial Sequence
  derived and/or modified CDS sequence (AUadapt) from InfluenzaA__AHC59812__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccagguggugcugugcgagcccacgaucaucgagcgcaacaucaccgagaucgucuaccucaccaacaccacgaucgagaaggagaucugccccaagccggccgaguaccggaacuggucgaagccccagugcgacaucaccggguucgcgcccuucuccaaggacaacagcauccgccuguccgccggcggggacaucugggugacccgggagcccuacgugucgugcgacccggacaagugcuaccaguucgcccugggccaggggaccacgcucaacaacguccacuccaacaacaccgugcgcgaccggacccccuaccgcacccugcugaugaacgagcucggcgugcccuuccaccugggcacgaagcaggucugcaucgccuggagcuccucguccugccacgacgggaaggccuggcugcacgugugcaucaccggcgacgacaagaacgcgaccgccagcuucaucuacaacgggcggcucguggacuccgucgugucgugguccaaggagauccugcgcacccaggagagcgagugcgugugcaucaacggcacgugcaccgucgugaugaccgacggguccgccucgggcaaggccgacaccaagauccuguucaucgaggagggcaagaucguguacacgagcacccucuccgggucggcgcagcacgucgaggagugcuccugcuacccccgguacccgggcgugcgcugcgugugccgggacaacuggaaggggagcaaccgccccaucgucgacaucaacaucaaggaccacuccaucgugucguccuacgugugcagcggccuggucggcgacaccccgcggaagaacgacuccucguccagcucccacugccuggaccccaacaacgaggagggcgggcacggggugaagggcugggccuucgacgacgggaacgacgucuggaugggccgcaccaucaacgagacgucgcggcucggcuacgagaccuucaaggugaucgaggggugguccaaccccaagagcaagcugcagaucaaccgccaggugaucgucgaccggggcgaccgcuccggguacucgggcaucuucuccguggagggcaagagcugcaucaaccggugcuucuacguggagcugauccgcgggcggaaggaggagaccgagguccucuggaccucgaacuccaucgugguguucugcggcacgagcgggaccuacggcaccggguccuggcccgacggcgccgaccugaaccugaugcccaucuga

SEQ ID NO: 26500 - RNA, 1410 nt, Artificial Sequence
  derived and/or modified CDS sequence (AUadapt) from InfluenzaA__AHC59824__NA
augaaccccaaccagaagaucaucaccaucggcucggugucccugaccaucagcacgaucugcuucuucaugcagaucgccauccucaucaccaccgucacccugcacuucaagcaguacgaguucuacuccccgcccaacaaccaggugaugcugugcgagcccacgaucaucgagcgcaacaucaccgagaucguguaccucaccaacaccacgaucgagaaggagaucugccccaagcuggccgaguaccggaaguggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccucgucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagucgaagcugcagaucaaccgccaggugaucguggaccggggcaaccgcuccggguacagcggcaucuucuccgucgagggcaagucgugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 26501 - RNA, 1410 nt, Artificial Sequence; identical to SEQ ID NO: 26377
  derived and/or modified CDS sequence (AUadapt) from InfluenzaA__AHC59836__NA

SEQ ID NO: 26502 - RNA, 1410 nt, Artificial Sequence; identical to SEQ ID NO: 25324
  derived and/or modified CDS sequence (AUadapt) from InfluenzaA__AHC59848__NA

SEQ ID NO: 26503 - RNA, 1410 nt, Artificial Sequence; identical to SEQ ID NO: 26373
  derived and/or modified CDS sequence (AUadapt) from InfluenzaA__AHC59860__NA

SEQ ID NO: 26504 - RNA, 1410 nt, Artificial Sequence; identical to SEQ ID NO: 26420
  derived and/or modified CDS sequence (AUadapt) from InfluenzaA__AHC59872__NA

SEQ ID NO: 26505 - RNA, 1410 nt, Artificial Sequence; identical to SEQ ID NO: 26409
  derived and/or modified CDS sequence (AUadapt) from InfluenzaA__AHC59884__NA

SEQ ID NO: 26506 - RNA, 1410 nt, Artificial Sequence
  derived and/or modified CDS sequence (AUadapt) from InfluenzaA__AHC59895__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucaaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggaccggggcaaccgcuccggguacucgggcaucuucuccgucgagggcaagagcugcaucaaccggugcuucuacguggagcucauccgcgggcggaaggaggagaccgaggugcuguggaccucgaacuccaucgucguguucugcggcacgagcgggaccuacggcaccggguccuggccggacggcgccgaccugaaccucaugcccaucuga

SEQ ID NO: 26507 - RNA, 1410 nt, Artificial Sequence; identical to SEQ ID NO: 26377
  derived and/or modified CDS sequence (AUadapt) from InfluenzaA__AHC59907__NA

SEQ ID NO: 26508 - RNA, 1410 nt, Artificial Sequence
  derived and/or modified CDS sequence (AUadapt) from InfluenzaA__AHC59918__NA
augaaccccaaccagaagaucaucaccaucggcucggugucccugaccaucagcacgaucugcuucuucauccagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaugaaccgccaggugaucguggaccggggcaaccgcuccggguacucgggcaucuucuccgucgagggcaagagcugcaucaaccggugcuucuacguggagcucauccgcgggcggaaggaggagaccgaggugcuguggaccucgaacuccaucgucguguucugcggcacgagcgggaccuacggcaccggguccuggccggacggcgccgaccugaaccucaugcccaucuga

SEQ ID NO: 26509 - RNA, 1410 nt, Artificial Sequence; identical to SEQ ID NO: 26508
  derived and/or modified CDS sequence (AUadapt) from InfluenzaA__AHC59930__NA

SEQ ID NO: 26510 - RNA, 1410 nt, Artificial Sequence; identical to SEQ ID NO: 26377
  derived and/or modified CDS sequence (AUadapt) from InfluenzaA__AHC59942__NA

SEQ ID NO: 26511 - RNA, 1410 nt, Artificial Sequence; identical to SEQ ID NO: 26422
  derived and/or modified CDS sequence (AUadapt) from InfluenzaA__AHC59954__NA

SEQ ID NO: 26512 - RNA, 1410 nt, Artificial Sequence
  derived and/or modified CDS sequence (AUadapt) from InfluenzaA__AHC59966__NA
augaaccccaaccagaagaucaucaccaucggcucggugucccugaccaucucgacgaucugcuucuucaugcagaucgccauccucaucaccaccgucacccugcacuucaagcaguacgaguucaacuccagcccgaacaaccaggugaugcugugcgagcccacgaucaucgagcgcaacaucaccgagaucguguaccucaccaacaccacgaucgagaaggagaucugccccaagcccgccgaguaccggaacugguccaagccgcagugcgacaucaccggguucgcgcccuucucgaaggacaacuccauccgccugagcgccggcggggacaucugggucacccgggagcccuacguguccugcgaccccgacaagugcuaccaguucgcccugggccaggggaccacgcucaacaacgugcacucgaacaacaccguccgcgaccggaccccguaccgcacccugcugaugaacgagcucggcgugcccuuccaccugggcacgaagcaggucugcaucgccugguccagcuccucgugccacgacgggaaggccuggcugcacgugugcaucaccggcgacgacaagaacgcgaccgccuccuucaucuacaacgggcggcucguggacagcguggucuccuggucgaaggagauccugcgcacccaggaguccgagugcgugugcaucaacggcacgugcaccguggucaugaccgacgggagcgccucgggcaaggccgacaccaagauccuguucaucgaggagggcaagaucgugcacacguccacccucagcggguccgcgcagcacguggaggagugcucgugcuacccccgguaccccggcguccgcugcgugugccgggacaacuggaagggguccaaccgcccgaucguggacaucaacaucaaggaccacagcaucgucuccucguacgugugcuccggccuggugggcgacacgccccggaagaacgacagcuccucguccagccacugccuggaccccaacaacgaggagggcgggcacggggucaagggcugggccuucgacgacgggaacgacguguggaugggccgcaccaucaacgagaccucccggcucggcuacgagaccuucaaggucaucgagggguggucgaaccccaaguccaagcugcagaucaaccgccaggugaucguggaccggggcgacgggagcggcuacuccgggaucuucucggucgagggcaagagcugcaucaaccgcugcuucuacguggagcugauccggggccgcaaggaggagaccgaggugcucuggaccuccaacucgaucgucguguucugcgggacguccggcaccuacgggaccggcagcuggccggacggggccgaccugaaccugaugcccaucuga

SEQ ID NO: 26513 - RNA, 1410 nt, Artificial Sequence; identical to SEQ ID NO: 25324
  derived and/or modified CDS sequence (AUadapt) from InfluenzaA__AHC59978__NA

SEQ ID NO: 26514 - RNA, 1410 nt, Artificial Sequence; identical to SEQ ID NO: 23286
  derived and/or modified CDS sequence (AUadapt) from InfluenzaA__AHC59990__NA

SEQ ID NO: 26515 - RNA, 1410 nt, Artificial Sequence; identical to SEQ ID NO: 26422
  derived and/or modified CDS sequence (AUadapt) from InfluenzaA__AHC60002__NA

SEQ ID NO: 26516 - RNA, 1410 nt, Artificial Sequence; identical to SEQ ID NO: 26377
  derived and/or modified CDS sequence (AUadapt) from InfluenzaA__AHC60014__NA

SEQ ID NO: 26517 - RNA, 1410 nt, Artificial Sequence; identical to SEQ ID NO: 21920
  derived and/or modified CDS sequence (AUadapt) from InfluenzaA__AHC60026__NA

SEQ ID NO: 26518 - RNA, 1410 nt, Artificial Sequence; identical to SEQ ID NO: 26373
  derived and/or modified CDS sequence (AUadapt) from InfluenzaA__AHC60038__NA

SEQ ID NO: 26519 - RNA, 1410 nt, Artificial Sequence; identical to SEQ ID NO: 26373
  derived and/or modified CDS sequence (AUadapt) from InfluenzaA__AHC60050__NA

SEQ ID NO: 26520 - RNA, 1410 nt, Artificial Sequence
  derived and/or modified CDS sequence (AUadapt) from InfluenzaA__AHC60062__NA
augaaccccaaccagaagaucaucaccaucggcucggugucccugaccaucagcacgaucugcuucuucaugcagaucgccauccucaucaccaccgucaccaugcacuucaagcaguacgaguucaacuccccgcccaacaaccaggugaugcugugcgagcccacgaucaucgagcgcaacaucaccgagaucguguaccugaccaacaccacgaucgagaaggagaucugccccaagcucgccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccugggccaggggaccacgcucaacaacgugcacuccaacaacaccguccgcgaccggaccccguaccgcacccugcugaugaacgagcucggcgugcccuuccaccugggcacgaagcaggucugcaucgccuggagcuccucguccugccacgacgggaaggccuggcugcacgugugcaucaccggcgacgacaagaacgcgaccgccagcuucaucuacaacgggaagcucguggacuccguggucucgugguccaaggagauccugcggacccaggagagcgagugcgugugcaucaacggcacgugcaccguggucaugaccgacggguccgccucgggcaaggccgacaccaagauccuguucaucgaggagggcaagaucgugcacacgagcacccucuccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccuggaccccaacaacgaggagggcgggcacggggucaagggcugggccuucgacgacgggaacgacguguggaugggccggaccaucaacgagaccucgcgccucggcuacgagaccuucaaggucaucgaggggugguccaaccccaagagcaagcugcagaucaaccgccaggugaucguggaccggggcaaccgguccggguacucgggcaucuucuccgucgagggcaagagcugcaucaaccgcugcuucuacguggagcugauccgggggcgcaaggaggagaccgaggugcucuggaccucgaacuccaucgucguguucugcggcacgagcgggaccuacggcaccggguccuggccggacggcgccgaccugaaccugaugcccaucuga

SEQ ID NO: 26521 - RNA, 1410 nt, Artificial Sequence; identical to SEQ ID NO: 25324
  derived and/or modified CDS sequence (AUadapt) from InfluenzaA__AHC60074__NA

SEQ ID NO: 26522 - RNA, 1410 nt, Artificial Sequence; identical to SEQ ID NO: 26377
  derived and/or modified CDS sequence (AUadapt) from InfluenzaA__AHC60086__NA

SEQ ID NO: 26523 - RNA, 1410 nt, Artificial Sequence
  derived and/or modified CDS sequence (AUadapt) from InfluenzaA__AHC60098__NA
augaaccccaaccagaagaucaucaccaucggcucggugucccugaccaucagcacgaucugcuucuucaugcagaucgccauccucaucaccaccgucacccugcacuucaagcaguacgaguucuacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccucgucccacugccucgaccccaacaacgaggagggcgggcacggggucaagggcugggccuucgacgacgggaacgacguguggaugggccgcaccaucgacgagaccagccggcugggcuacgagaccuucaaggucaucgaggggugguccaaccccaagucgaagcugcagaucaaccgccaggugaucguggaccggggcaaccgcuccggguacagcggcaucuucuccgucgagggcaagucgugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 26524 - RNA, 1410 nt, Artificial Sequence; identical to SEQ ID NO: 26373
  derived and/or modified CDS sequence (AUadapt) from InfluenzaA__AHC60110__NA

SEQ ID NO: 26525 - RNA, 1410 nt, Artificial Sequence; identical to SEQ ID NO: 26450
  derived and/or modified CDS sequence (AUadapt) from InfluenzaA__AHC60122__NA

SEQ ID NO: 26526 - RNA, 1410 nt, Artificial Sequence; identical to SEQ ID NO: 26377
  derived and/or modified CDS sequence (AUadapt) from InfluenzaA__AHC60134__NA

SEQ ID NO: 26527 - RNA, 1410 nt, Artificial Sequence; identical to SEQ ID NO: 26431
  derived and/or modified CDS sequence (AUadapt) from InfluenzaA__AHC60146__NA

SEQ ID NO: 26528 - RNA, 1410 nt, Artificial Sequence; identical to SEQ ID NO: 26508
  derived and/or modified CDS sequence (AUadapt) from InfluenzaA__AHC60158__NA

SEQ ID NO: 26529 - RNA, 1410 nt, Artificial Sequence; identical to SEQ ID NO: 26373
  derived and/or modified CDS sequence (AUadapt) from InfluenzaA__AHC60182__NA

SEQ ID NO: 26530 - RNA, 1410 nt, Artificial Sequence
  derived and/or modified CDS sequence (AUadapt) from InfluenzaA__AHC60206__NA
augaaccccaaccagaagaucaucaccaucggcucggugucccugaccaucagcaucaucugcuucuucaugcaggucgccauccucaucacgaccgugacccugcacuucaagcaguacgaguucaacuccccgcccaacaaccaggugaugcugugcgagcccaccaucaucgagcgcaacaucacggagaucgucuaccucaccaacaccaccaucgagaaggagaucugccccaagcuggccgaguaccggaacuggucgaagccgcagugcgacaucacgggguucgcgcccuucuccaaggacaacagcauccgccuguccgccggcggggacaucugggugacccgggagcccuacgugucgugcgaccccgacaagugcuaccaguucgcccucggccaggggaccacccugaacaacguccacuccaacaacacggugcgcgaccggaccccguaccgcacccugcucaugaacgagcugggcgugcccuuccaccugggcaccaagcaggucugcaucgccuggagcuccucguccugccacgacgggaaggccuggcuccacgugugcaucacgggcgacgacaagaacgcgaccgccagcuucaucuacaacgggaagcugguggacuccgucgugucgugguccaaggagauccugcggacccaggagagcgagugcgugugcaucaacgggaccugcacggucgugaugaccgacggguccgccucgggcaaggccgacaccaagauccucuucaucgaggagggcaagaucgugcacaccagcacgcuguccgggagcgcgcagcacgucgaggagugcuccugcuacccccgcuaccccggcgugcggugcgugugccgcgacaacuggaaggggucgaaccggccgaucgucgacaucaacaucaaggaccacuccaucgugagcuccuacgugugcucgggccuggucggcgacacgccccgcaagaacgacuccagcuccucgucccacugccucgaccccaacaacgaggagggcggccacggggugaagggcugggccuucgacgacgggaacgacgucuggaugggccggaccaucaacgagaccagccgccugggcuacgagaccuucaaggugaucgaggggugguccaaccccaagucgaagcugcagaucaaccgccaggugaucgucgaccggggcaaccgguccggguacagcggcaucuucuccguggagggcaagucgugcaucaaccgcugcuucuacguggagcucauccgggggcgcaaggaggagaccgagguccuguggaccagcaacuccaucgugguguucugcggcaccagcgggacguacggcaccggguccuggccggacggcgccgaccugaaccucaugcccaucuga

SEQ ID NO: 26531 - RNA, 1410 nt, Artificial Sequence; identical to SEQ ID NO: 25324
  derived and/or modified CDS sequence (AUadapt) from InfluenzaA__AHC60218__NA

SEQ ID NO: 26532 - RNA, 1410 nt, Artificial Sequence; identical to SEQ ID NO: 21920
  derived and/or modified CDS sequence (AUadapt) from InfluenzaA__AHC60230__NA

SEQ ID NO: 26533 - RNA, 1410 nt, Artificial Sequence; identical to SEQ ID NO: 26373
  derived and/or modified CDS sequence (AUadapt) from InfluenzaA__AHC60242__NA

SEQ ID NO: 26534 - RNA, 1410 nt, Artificial Sequence; identical to SEQ ID NO: 26373
  derived and/or modified CDS sequence (AUadapt) from InfluenzaA__AHC60254__NA

SEQ ID NO: 26535 - RNA, 1410 nt, Artificial Sequence; identical to SEQ ID NO: 26373
  derived and/or modified CDS sequence (AUadapt) from InfluenzaA__AHC60266__NA

SEQ ID NO: 26536 - RNA, 1410 nt, Artificial Sequence; identical to SEQ ID NO: 26422
  derived and/or modified CDS sequence (AUadapt) from InfluenzaA__AHC60278__NA

SEQ ID NO: 26537 - RNA, 1410 nt, Artificial Sequence; identical to SEQ ID NO: 26373
  derived and/or modified CDS sequence (AUadapt) from InfluenzaA__AHC60290__NA

SEQ ID NO: 26538 - RNA, 1410 nt, Artificial Sequence
  derived and/or modified CDS sequence (AUadapt) from InfluenzaA__AHC60302__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucauccacacgagcacccuguccgggucggcgcagcacguggaggagugcuccugcuacccccgcuaccccggcgugcggugcgucugccgcgacaacuggaaggggagcaaccggccgaucguggacaucaacaucaaggaccacuccaucgugucguccuacgucugcagcggccuggugggcgacacgccccgcaagaacgacuccucguccagcucccacugccucgaccccaacaacgaggagggcgggcacggggugaagggcugggccuucgacgacgggaacgacgucuggaugggccggaccaucaacgagaccucgcgccugggcuacgagaccuucaaggugaucgaggggugguccaaccccaagagcaagcugcagaucaaccggcaggucaucguggaccgcggcaaccgguccggguacucgggcaucuucuccguggagggcaagagcugcaucaaccgcugcuucuacgucgagcucauccgggggcgcaaggaggagaccgaggugcuguggaccucgaacuccaucguggucuucugcggcacgagcgggaccuacggcaccggguccuggccggacggcgccgaccugaaccucaugcccaucuga

SEQ ID NO: 26539 - RNA, 1410 nt, Artificial Sequence; identical to SEQ ID NO: 26373
  derived and/or modified CDS sequence (AUadapt) from InfluenzaA__AHC60314__NA

SEQ ID NO: 26540 - RNA, 1410 nt, Artificial Sequence; identical to SEQ ID NO: 26373
  derived and/or modified CDS sequence (AUadapt) from InfluenzaA__AHC60326__NA

SEQ ID NO: 26541 - RNA, 1410 nt, Artificial Sequence
  derived and/or modified CDS sequence (AUadapt) from InfluenzaA__AHC60338__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcgggcacggggucaagggcugggccuucgacgacggggacgacguguggaugggccgcaccaucaacgagacgucgcggcucggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcccaucuga

SEQ ID NO: 26542 - RNA, 1410 nt, Artificial Sequence; identical to SEQ ID NO: 23286
  derived and/or modified CDS sequence (AUadapt) from InfluenzaA__AHC60350__NA

SEQ ID NO: 26543 - RNA, 1410 nt, Artificial Sequence
  derived and/or modified CDS sequence (AUadapt) from InfluenzaA__AHC60362__NA
augaaccccaaccagaagaucaucaccaucggcucggugucccugaccaucagcacgaucugcuucuucaugcaggucgccauccucaucaccaccgugacccugcacuucaagcaguacgaguucaacuccccgcccaacaaccaggugaugcugugcaagcccacgaucaucgagcgcaacaucaccgagaucgucuaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccgucgugucgugguccaaggagauccugcggacccaggagagcgagugcgugugcaucaacggcacgugcaccgucgugaugaccgacggguccgccucgggcaaggccgacaccaagauccucuucaucgaggagggcaagaucgugcacacgagcacccuguccgggucggcgcagcacgucgaggagugcuccugcuacccccgcuaccccggcgugcggugcgugugccgcgacaacuggaaggggagcaaccggccgaucgucgacaucaacaucaaggaccacuccaucgugucguccuacgugugcagcggccuggucggcgacacgccccgcaagaacgacuccucguccagcucccacugccucgaccccaacaacgaggagggcgggcacggggugaagggcugggccuucgacgacgggaacgacgucuggaugggccggaccaucaacgagaccucgcgccugggcuacgagaccuucaaggugaucgaggggugguccaaccccaagagcaagcugcagaucaaccgccaggugaucgucgaccggggcaaccgguccggguacucgggcaucuucuccguggagggcaagagcugcaucaaccgcugcuucuacguggagcucauccgggggcgcaaggaggagaccgagguccuguggaccucgaacuccaucgugguguucugcggcacgagcgggaccuacggcaccggguccuggccggacggcgccgaccugaaccucaugcccaucuga

SEQ ID NO: 26544 - RNA, 1410 nt, Artificial Sequence; identical to SEQ ID NO: 26285
  derived and/or modified CDS sequence (AUadapt) from InfluenzaA__AHC60374__NA

SEQ ID NO: 26545 - RNA, 1410 nt, Artificial Sequence; identical to SEQ ID NO: 21920
  derived and/or modified CDS sequence (AUadapt) from InfluenzaA__AHC60386__NA

SEQ ID NO: 26546 - RNA, 1410 nt, Artificial Sequence; identical to SEQ ID NO: 26377
  derived and/or modified CDS sequence (AUadapt) from InfluenzaA__AHC60398__NA

SEQ ID NO: 26547 - RNA, 1410 nt, Artificial Sequence; identical to SEQ ID NO: 26409
  derived and/or modified CDS sequence (AUadapt) from InfluenzaA__AHC60410__NA

SEQ ID NO: 26548 - RNA, 1410 nt, Artificial Sequence; identical to SEQ ID NO: 21920
  derived and/or modified CDS sequence (AUadapt) from InfluenzaA__AHC60422__NA

SEQ ID NO: 26549 - RNA, 1410 nt, Artificial Sequence; identical to SEQ ID NO: 26409
  derived and/or modified CDS sequence (AUadapt) from InfluenzaA__AHC60434__NA

SEQ ID NO: 26550 - RNA, 1410 nt, Artificial Sequence; identical to SEQ ID NO: 26377
  derived and/or modified CDS sequence (AUadapt) from InfluenzaA__AHC60446__NA

SEQ ID NO: 26551 - RNA, 1410 nt, Artificial Sequence
  derived and/or modified CDS sequence (AUadapt) from InfluenzaA__AHC60458__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacccaggagucggagugcgugugcaucaacggcacgugcgccguggucaugaccgacggguccgccagcggcaaggcggacaccaagauccucuucaucgaggagggcaagaucgugcacaccucgacgcuguccgggucggcccagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacggguccucguccagccacugccucgaccccaacaacgaggagggcgggcacggcgucaaggggugggccuucgacgacggcaacgacguguggaugggccgcaccaucaacgagaccucccggcugggguacgagaccuucaaggucaucgagggcuggucgaaccccaaguccaagcugcagaucaaccgccaggugaucguggaccgggggaaccgcagcggcuacuccgggaucuucucggucgagggcaaguccugcaucaaccggugcuucuacguggagcucauccgcggccggaaggaggagaccgaggugcuguggaccagcaacucgaucgucguguucugcgggaccuccggcacguacgggaccggcagcuggccggacggggccgaccugaaccucaugcccaucuga

SEQ ID NO: 26552 - RNA, 1410 nt, Artificial Sequence; identical to SEQ ID NO: 26422
  derived and/or modified CDS sequence (AUadapt) from InfluenzaA__AHC60470__NA

SEQ ID NO: 26553 - RNA, 1410 nt, Artificial Sequence
  derived and/or modified CDS sequence (AUadapt) from InfluenzaA__AHC60482__NA
augaaccccaaccagaagaucaucaccaucggcucggugucccugaccaucucgacgaucugcuucuucaugcagaucgccauccucaccaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggacgacccucaacaacgugcacuccaacaacaccguccgcgaccggacccccuaccgcacgcugcugaugaacgagcucggcgugcccuuccaccugggcaccaagcaggucugcaucgccuggucguccucguccugccacgacgggaaggccuggcugcacgugugcaucaccggcgacgacaagaacgcgaccgccagcuucaucuacaacgggcggcucguggacuccguggucucgugguccaaggagauccugcgcacgcaggagagcgagugcgugugcaucaacgggaccugcaccguggucaugaccgacggguccgccucgggcaaggccgacacgaagauccuguucaucgaggagggcaagaucgugcacaccagcacccucuccgggucggcgcagcacguggaggagugcuccugcuacccccgguacccgggcguccgcugcgugugccgggacaacuggaaggggucgaaccgccccaucguggacaucaacaucaaggaccacuccaucgucagcuccuacgugugcucgggccuggugggcgacaccccgcggaagaacgacuccagcuccucgucccacugccuggaccccaacaacgaggagggcggccacggggucaagggcugggccuucgacgacgggaacgacguguggaugggccgcacgaucaacgagaccucgcggcucggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggacgucgaacuccaucgucguguucugcggcaccagcgggaccuacggcaccggguccuggcccgacggcgccgaccugaaccugaugcccaucuga

SEQ ID NO: 26554 - RNA, 1410 nt, Artificial Sequence; identical to SEQ ID NO: 26373
  derived and/or modified CDS sequence (AUadapt) from InfluenzaA__AHC60494__NA

SEQ ID NO: 26555 - RNA, 1410 nt, Artificial Sequence; identical to SEQ ID NO: 26373
  derived and/or modified CDS sequence (AUadapt) from InfluenzaA__AHC60506__NA

SEQ ID NO: 26556 - RNA, 1410 nt, Artificial Sequence; identical to SEQ ID NO: 26377
  derived and/or modified CDS sequence (AUadapt) from InfluenzaA__AHC60518__NA

SEQ ID NO: 26557 - RNA, 1410 nt, Artificial Sequence; identical to SEQ ID NO: 26377
  derived and/or modified CDS sequence (AUadapt) from InfluenzaA__AHC60542__NA

SEQ ID NO: 26558 - RNA, 1410 nt, Artificial Sequence
  derived and/or modified CDS sequence (AUadapt) from InfluenzaA__AHC60554__NA
augaaccccaaccagaagaucaucaccaucggcucggugucccugaccaucagcacgaucugcuucuucaugcagaucgccauccucaucaccaccgucacccugcacuucaagcaguacgaguucuacuccccgcccaacaaccaggugaugcugugcgagcccacgaugaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggaccggggcaaccgcuccggguacucgggcaucuucuccgucgagggcaagagcugcaucaaccggugcuucuacguggagcucauccgcgggcggaaggaggagaccgaggugcuguggaccucgaacuccaucgucguguucugcggcacgagcgggaccuacggcaccgggaccuggccggacggcgccgaccugaaccucaugcccaucuga

SEQ ID NO: 26559 - RNA, 1410 nt, Artificial Sequence
  derived and/or modified CDS sequence (AUadapt) from InfluenzaA__AHC60566__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcgggcacggggucaagggcugggccuucgacgacgggaacgacguguggaugggccgcaccaucaacgagacgucgcggcucggcuacgagaccuucaaggucaucgaggggugguccaaccccaagagcaagcuccaggugaaccgccaggugaucgucgaccggggcgaccgcuccggguacucgggcaucuucuccguggagggcaagagcugcaucaaccggugcuucuacguggagcugauccgcgggcggaaggaggagaccgagguccuguggaccucgaacuccaucgugguguucugcggcacgagcgggaccuacggcaccggguccuggcccgacggcgccgaccugaaccugaugcccaucuga

SEQ ID NO: 26560 - RNA, 1410 nt, Artificial Sequence; identical to SEQ ID NO: 25324
  derived and/or modified CDS sequence (AUadapt) from InfluenzaA__AHC60578__NA

SEQ ID NO: 26561 - RNA, 1410 nt, Artificial Sequence; identical to SEQ ID NO: 26373
  derived and/or modified CDS sequence (AUadapt) from InfluenzaA__AHC60590__NA

SEQ ID NO: 26562 - RNA, 1410 nt, Artificial Sequence
  derived and/or modified CDS sequence (AUadapt) from InfluenzaA__AHC60602__NA
augaaccccaaccagaagaucaucaccaucggcucggugucccugaccaucucgacgaucugcuucuucaugcagaucgccauccucaucaccaccgucacccugcacuucaagcaguacgaguucaacccgccgcccaacaaccagguggugcugugcgagcccacgaucaucgagcgcaacaucaccgagaucgucuaccucaccaacaccacgaucgagaaggagaucugccccaagcccgccgaguaccggaacugguccaagccccagugcgacaucaccggguucgcgcccuucagcaaggacaacuccauccgccugucggccggcggggacaucugggugacccgggagccguacguguccugcgaccccgacaagugcuaccaguucgcccugggccaggggaccacgcucaacaacguccacagcaacaacaccgugcgcgaccggacccccuaccgcacccugcugaugaacgagcucggcgugcccuuccaccugggcacgaagcaggucugcaucgccugguccucguccucgugccacgacgggaaggccuggcugcacgugugcaucaccggcgacgacaagaacgcgaccgccuccuucaucuacaacgggcggcucguggacagcgucguguccuggucgaaggagauccugcgcacccaggaguccgagugcgugugcaucaacggcacgugcaccgucgugaugaccgacgggagcgccuccggcaaggccgacaccaagauccuguucaucgaggagggcaagaucgugcacacgucgacccucagcggguccgcgcagcacgucgaggagugcucgugcuacccgcgguaccccggcgugcgcugcgugugccgggacaacuggaagggguccaaccgccccaucgucgacaucaacaucaaggaccacucgaucguguccagcuacgugugcuccggccuggucggcgacacgccccggaagaacgacucguccagcuccucgcacugccuggacccgaacaacgaggagggcgggcacggggugaagggcugggccuucgacgacgggaacgacgucuggaugggccgcaccaucaacgagaccucccggcucggcuacgagaccuucaaggugaucgagggguggucgaaccccaaguccaagcugcagaucaaccgccaggugaucgucgaccggggcgaccgcagcggguacuccggcaucuucucgguggaggggaaguccugcaucaaccggugcuucuacguggagcugauccgcggccggaaggaggagaccgagguccucuggaccagcaacucgaucgugguguucugcggcacguccgggaccuacggcaccgggagcuggcccgacggcgccgaccugaaccugaugcccaucuga

SEQ ID NO: 26563 - RNA, 1410 nt, Artificial Sequence; identical to SEQ ID NO: 21920
  derived and/or modified CDS sequence (AUadapt) from InfluenzaA__AHC60614__NA

SEQ ID NO: 26564 - RNA, 1410 nt, Artificial Sequence; identical to SEQ ID NO: 25324
  derived and/or modified CDS sequence (AUadapt) from InfluenzaA__AHC60626__NA

SEQ ID NO: 26565 - RNA, 1410 nt, Artificial Sequence
  derived and/or modified CDS sequence (AUadapt) from InfluenzaA__AHC60650__NA
augaaccccaaccagaagaucaucaccaucggcucggugucccugaccaucagcacgaucugcuucuucaugcagaucgccauccucaucaccaccgucacccugcacuucaagcaguacgaguucuacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacgagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccucgucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagucgaagcugcagaucaaccgccaggugaucguggaccggggcaaccgcuccggguacagcggcaucuucuccgucgagggcaagucgugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 26566 - RNA, 1410 nt, Artificial Sequence; identical to SEQ ID NO: 26422
  derived and/or modified CDS sequence (AUadapt) from InfluenzaA__AHC60662__NA

SEQ ID NO: 26567 - RNA, 1410 nt, Artificial Sequence; identical to SEQ ID NO: 26377
  derived and/or modified CDS sequence (AUadapt) from InfluenzaA__AHC60674__NA

SEQ ID NO: 26568 - RNA, 1410 nt, Artificial Sequence; identical to SEQ ID NO: 21920
  derived and/or modified CDS sequence (AUadapt) from InfluenzaA__AHC60686__NA

SEQ ID NO: 26569 - RNA, 1410 nt, Artificial Sequence; identical to SEQ ID NO: 26377
  derived and/or modified CDS sequence (AUadapt) from InfluenzaA__AHC60698__NA

SEQ ID NO: 26570 - RNA, 1410 nt, Artificial Sequence; identical to SEQ ID NO: 26373
  derived and/or modified CDS sequence (AUadapt) from InfluenzaA__AHC60710__NA

SEQ ID NO: 26571 - RNA, 1410 nt, Artificial Sequence; identical to SEQ ID NO: 26422
  derived and/or modified CDS sequence (AUadapt) from InfluenzaA__AHC60722__NA

SEQ ID NO: 26572 - RNA, 1410 nt, Artificial Sequence
  derived and/or modified CDS sequence (AUadapt) from InfluenzaA__AHC60734__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaucaacaccaccaucgagaaggagaucugccccaagcuggccgaguaccggaacuggucgaagccgcagugcgacaucacgggguucgcgcccuucuccaaggacaacagcauccgccuguccgccggcggggacaucugggucacccgggagcccuacgugucgugcgaccccaacaagugcuaccaguucgcccucggccaggggaccacccugaacaacgugcacuccaacaacacgguccgcgaccggaccccguaccgcacccugcucaugaacgagcugggcgugcccuuccaccugggcaccaagcaggucugcaucgccuggagcuccucguccugccacgacgggaaggccuggcuccacgugugcaucacgggcgacgacaagaacgcgaccgccagcuucaucuacaacgggaagcugguggacuccguggucucgugguccaaggagauccugcggacccaggagagcgagugcgugugcaucaacgggaccugcacgguggucaugaccgacggguccgccucgggcaaggccgacaccaagauccucuucaucgaggagggcaagaucgugcacaccagcacgcuguccgggagcgcgcagcacguggaggagugcuccugcuacccccgcuaccccggcguccggugcgugugccgcgacaacuggaaggggucgaaccggccgaucguggacaucaacaucaaggaccacuccaucgucagcuccuacgugugcucgggccuggugggcgacacgccccgcaagaacgacuccagcuccucgucccacugccucgaccccaacaacgaggagggcggccacggggucaagggcugggccuucgacgacgggaacgacguguggaugggccggaccaucaacgagaccagccgccugggcuacgagaccuucaaggucaucgaggggugguccaaccccaagucgaagcugcagaucaaccgccaggugaucguggaccggggcaaccgguccggguacagcggcaucuucuccgucgagggcaagucgugcaucaaccgcugcuucuacguggagcucauccgggggcgcaaggaggagaccgaggugcuguggaccagcaacuccaucgucguguucugcggcaccagcgggacguacggcaccggguccuggccggacggcgccgaccugaaccucaugcccaucuga

SEQ ID NO: 26573 - RNA, 1410 nt, Artificial Sequence; identical to SEQ ID NO: 26409
  derived and/or modified CDS sequence (AUadapt) from InfluenzaA__AHC60746__NA

SEQ ID NO: 26574 - RNA, 1410 nt, Artificial Sequence; identical to SEQ ID NO: 26508
  derived and/or modified CDS sequence (AUadapt) from InfluenzaA__AHC60770__NA

SEQ ID NO: 26575 - RNA, 1410 nt, Artificial Sequence
  derived and/or modified CDS sequence (AUadapt) from InfluenzaA__AHC60782__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucgggcuacgugugcuccggccuggugggggacacgccccggaagaacgacagcuccucguccagccacugccucgaccccaacaacgaggagggcgggcacggcgucaaggggugggccuucgacgacggcaacgacguguggaugggccgcaccaucaacgagaccucccggcugggguacgagaccuucaaggucaucgagggcuggucgaaccccaaguccaagcugcagaucaaccgccaggugaucguggaccgggggaaccgcagcggcuacuccgggaucuucucggucgagggcaaguccugcaucaaccggugcuucuacguggagcucauccgcggccggaaggaggagaccgaggugcuguggaccagcaacucgaucgucguguucugcgggacguccggcaccuacgggaccggcagcuggccggacggggccgaccugaaccucaugcccaucuga

SEQ ID NO: 26576 - RNA, 1410 nt, Artificial Sequence; identical to SEQ ID NO: 26420
  derived and/or modified CDS sequence (AUadapt) from InfluenzaA__AHC60794__NA

SEQ ID NO: 26577 - RNA, 1410 nt, Artificial Sequence
  derived and/or modified CDS sequence (AUadapt) from InfluenzaA__AHC60806__NA
augaaccccaaccagaagaucaucaccaucggcucggugucccugaccaucagcacgaucugcuucuucaugcagaucgccauccucaucaccaccgucacccugcacuucaagcagugcgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcugcagaucaaccgccaggugaucguggaccggggcaaccgguccggguacucgggcaucuucuccgucgagggcaagagcugcaucaaccgcugcuucuacguggagcucauccgggggcgcaaggaggagaccggcgugcuguggaccucgaacuccaucgucguguucugcgggacgagcggcaccuacgggaccggcuccuggccggacggggccgaccugaaccucaugcccaucuga

SEQ ID NO: 26578 - RNA, 1410 nt, Artificial Sequence; identical to SEQ ID NO: 23286
  derived and/or modified CDS sequence (AUadapt) from InfluenzaA__AHC60818__NA

SEQ ID NO: 26579 - RNA, 1410 nt, Artificial Sequence; identical to SEQ ID NO: 26377
  derived and/or modified CDS sequence (AUadapt) from InfluenzaA__AHC60830__NA

SEQ ID NO: 26580 - RNA, 1410 nt, Artificial Sequence; identical to SEQ ID NO: 26558
  derived and/or modified CDS sequence (AUadapt) from InfluenzaA__AHC60842__NA

SEQ ID NO: 26581 - RNA, 1410 nt, Artificial Sequence; identical to SEQ ID NO: 26377
  derived and/or modified CDS sequence (AUadapt) from InfluenzaA__AHC60854__NA

SEQ ID NO: 26582 - RNA, 1410 nt, Artificial Sequence; identical to SEQ ID NO: 26422
  derived and/or modified CDS sequence (AUadapt) from InfluenzaA__AHC60866__NA

SEQ ID NO: 26583 - RNA, 1410 nt, Artificial Sequence; identical to SEQ ID NO: 26409
  derived and/or modified CDS sequence (AUadapt) from InfluenzaA__AHC60878__NA

SEQ ID NO: 26584 - RNA, 1410 nt, Artificial Sequence; identical to SEQ ID NO: 26409
  derived and/or modified CDS sequence (AUadapt) from InfluenzaA__AHC60890__NA

SEQ ID NO: 26585 - RNA, 1410 nt, Artificial Sequence; identical to SEQ ID NO: 26508
  derived and/or modified CDS sequence (AUadapt) from InfluenzaA__AHC60902__NA

SEQ ID NO: 26586 - RNA, 1410 nt, Artificial Sequence; identical to SEQ ID NO: 26373
  derived and/or modified CDS sequence (AUadapt) from InfluenzaA__AHC60914__NA

SEQ ID NO: 26587 - RNA, 1410 nt, Artificial Sequence; identical to SEQ ID NO: 26377
  derived and/or modified CDS sequence (AUadapt) from InfluenzaA__AHC60926__NA

SEQ ID NO: 26588 - RNA, 1410 nt, Artificial Sequence; identical to SEQ ID NO: 26373
  derived and/or modified CDS sequence (AUadapt) from InfluenzaA__AHC60938__NA

SEQ ID NO: 26589 - RNA, 1410 nt, Artificial Sequence; identical to SEQ ID NO: 26377
  derived and/or modified CDS sequence (AUadapt) from InfluenzaA__AHC60950__NA

SEQ ID NO: 26590 - RNA, 1410 nt, Artificial Sequence
  derived and/or modified CDS sequence (AUadapt) from InfluenzaA__AHC60962__NA
augaaccccaaccagaagaucaucaccaucggcucggugucccugaccaucagcacgaucugcuucuucaugcagaucgccauccucaucaccaccgucacccugcacuucaagcaguacgaguucuacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcggcugguggacuccgucgugucgugguccaaggagauccugcgcacccaggagagcgagugcgugugcaucaacggcacgugcaccgucgugaugaccgacggguccgccucgggcaaggccgacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggucgaaccgcccgaucgucgacaucaacaucaaggaccacuccaucgugagcuccuacgugugcucgggccuggucggcgacacgccccggaagaacgacuccagcuccucgucccacugccucgaccccaacaacgaggagggcgggcacggggugaagggcugggccuucgacgacgggaacgacgucuggaugggccgcaccaucaacgagaccagccggcugggcuacgagaccuucaaggugaucgaggggugguccaaccccaagucgaagcugcagaucaaccgccaggugaucgucgaccggggcaaccgcuccggguacagcggcaucuucuccguggagggcaagucgugcaucaaccggugcuucuacguggagcucauccgcgggcggaaggaggagaccgagguccuguggaccagcaacuccaucgugguguucugcggcacgagcgggaccuacggcaccggguccuggccggacggcgccgaccugaaccucaugcccaucuga

SEQ ID NO: 26591 - RNA, 1410 nt, Artificial Sequence; identical to SEQ ID NO: 26422
  derived and/or modified CDS sequence (AUadapt) from InfluenzaA__AHC60974__NA

SEQ ID NO: 26592 - RNA, 1410 nt, Artificial Sequence; identical to SEQ ID NO: 26373
  derived and/or modified CDS sequence (AUadapt) from InfluenzaA__AHC60986__NA

SEQ ID NO: 26593 - RNA, 1410 nt, Artificial Sequence; identical to SEQ ID NO: 26520
  derived and/or modified CDS sequence (AUadapt) from InfluenzaA__AHC60998__NA

SEQ ID NO: 26594 - RNA, 1410 nt, Artificial Sequence; identical to SEQ ID NO: 26420
  derived and/or modified CDS sequence (AUadapt) from InfluenzaA__AHC61010__NA

SEQ ID NO: 26595 - RNA, 1410 nt, Artificial Sequence
  derived and/or modified CDS sequence (AUadapt) from InfluenzaA__AHC61022__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccaucagccacugccucgaccccaacaacgaggagggcgggcacggggucaagggcugggccuucgacgacgggaacgacguguggaugggccgcaccaucaacgagaccucccggcugggcuacgagaccuucaaggucaucgagggguggucgaaccccaaguccaagcugcagaucaaccgccaggugaucguggaccggggcaaccgcagcggguacuccggcaucuucucggucgaggggaaguccugcaucaaccggugcuucuacguggagcucauccgcggccggaaggaggagaccgaggugcuguggaccagcaacucgaucgucguguucugcggcacguccgggaccuacggcaccgggagcuggccggacggcgccgaccugaaccucaugcccaucuga

SEQ ID NO: 26596 - RNA, 1410 nt, Artificial Sequence; identical to SEQ ID NO: 21920
  derived and/or modified CDS sequence (AUadapt) from InfluenzaA__AHC61034__NA

SEQ ID NO: 26597 - RNA, 1410 nt, Artificial Sequence; identical to SEQ ID NO: 26373
  derived and/or modified CDS sequence (AUadapt) from InfluenzaA__AHC61046__NA

SEQ ID NO: 26598 - RNA, 1410 nt, Artificial Sequence; identical to SEQ ID NO: 26422
  derived and/or modified CDS sequence (AUadapt) from InfluenzaA__AHC61058__NA

SEQ ID NO: 26599 - RNA, 1410 nt, Artificial Sequence; identical to SEQ ID NO: 26285
  derived and/or modified CDS sequence (AUadapt) from InfluenzaA__AHC61070__NA

SEQ ID NO: 26600 - RNA, 1410 nt, Artificial Sequence
  derived and/or modified CDS sequence (AUadapt) from InfluenzaA__AHC61082__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccagguggugcugugcgagcccacgaucaucgagcgcaacaucaccgagaucgucuaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggugacccgggagcccuacgugagcugcgacccggacaagugcuaccaguucgcccugggccaggggaccacgcucaacaacguccacuccaacaacaccgugcgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccgucgugagcugguccaaggagauccugcgcacccaggagucggagugcgugugcaucaacggcacgugcaccgucgugaugaccgacggguccgccagcggcaaggccgacaccaagauccuguucaucgaggagggcaagaucgugcacacgucgacccucuccgggucggcgcagcacgucgaggagugcuccugcuacccccgguacccgggcgugcgcugcgugugccgggacaacuggaaggggagcaaccgccccaucgucgacaucaacaucaaggaccacuccaucgugucguccuacgugugcagcggccuggucggcgacaccccgcggaagaacgacuccucguccagcucccacugccuggaccccaacaacgaggagggcgggcacggggugaagggcugggccuucgacgacgggaacgacgucuggaugggccgcaccaucaacgagacgucgcggcucggcuacgagaccuucaaggugaucgaggggugguccaaccccaagagcaagcugcagaucaaccgccaggugaucgucgaccggggcgaccgcuccggguacucgggcaucuucuccguggagggcaagagcugcaucaaccggugcuucuacguggagcugauccgcgggcggaaggaggagaccggcguccucuggaccucgaacuccaucgugguguucugcgggacgagcggcaccuacgggaccggcuccuggcccgacggggccgaccugaaccugaugcccaucuga

SEQ ID NO: 26601 - RNA, 1410 nt, Artificial Sequence; identical to SEQ ID NO: 21920
  derived and/or modified CDS sequence (AUadapt) from InfluenzaA__AHC61094__NA

SEQ ID NO: 26602 - RNA, 1410 nt, Artificial Sequence; identical to SEQ ID NO: 26409
  derived and/or modified CDS sequence (AUadapt) from InfluenzaA__AHC61106__NA

SEQ ID NO: 26603 - RNA, 1410 nt, Artificial Sequence; identical to SEQ ID NO: 26409
  derived and/or modified CDS sequence (AUadapt) from InfluenzaA__AHC61118__NA

SEQ ID NO: 26604 - RNA, 1410 nt, Artificial Sequence; identical to SEQ ID NO: 26373
  derived and/or modified CDS sequence (AUadapt) from InfluenzaA__AHC61130__NA

SEQ ID NO: 26605 - RNA, 1410 nt, Artificial Sequence; identical to SEQ ID NO: 26520
  derived and/or modified CDS sequence (AUadapt) from InfluenzaA__AHC61142__NA

SEQ ID NO: 26606 - RNA, 1410 nt, Artificial Sequence; identical to SEQ ID NO: 26409
  derived and/or modified CDS sequence (AUadapt) from InfluenzaA__AHC61154__NA

SEQ ID NO: 26607 - RNA, 1410 nt, Artificial Sequence
  derived and/or modified CDS sequence (AUadapt) from InfluenzaA__AHC61166__NA
augaaccccaaccagaagaucaucaccaucggcucggugucccugaccaucucgacgaucugcuucuucaugcaggucgccauccucaucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggugacccgggagcccuacgugagcugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggaagcugguggacuccgucgugagcugguccaaggagauccugcggacccaggagucggagugcgugugcaucaacggcacgugcaccgucgugaugaccgacggguccgccagcggcaaggccgacaccaagauccucuucaucgaggagggcaagaucgugcacacgucgacccuguccgggucggcgcagcacgucgaggagugcuccugcuacccccgcuaccccggcgugcggugcgugugccgcgacaacuggaaggggagcaaccggccgaucgucgacaucaacaucaaggaccacuccaucgugucguccuacgugugcagcggccuggucggcgacacgccccgcaagaacgacuccucguccagcucccacugccucgaccccaacaacgaggagggcgggcacggggugaagggcugggccuucgacgacgggaacgacgucuggaugggccggaccaucaacgagaccucgcgccugggcuacgagaccuucaaggugaucgaggggugguccaaccccaagagcaagcugcagaccaaccgccaggugaucgucgaccggggcaaccgguccggguacucgggcaucuucuccguggagggcaagagcugcaucaaccgcugcuucuacguggagcucauccgggggcgcaaggaggagaccgagguccuguggacgucgaacuccaucgugguguucugcggcaccagcgggaccuacggcaccggguccuggccggacggcgccgaccugaaccucaugcccaucuga

SEQ ID NO: 26608 - RNA, 1410 nt, Artificial Sequence; identical to SEQ ID NO: 26373
  derived and/or modified CDS sequence (AUadapt) from InfluenzaA__AHC61178__NA

SEQ ID NO: 26609 - RNA, 1410 nt, Artificial Sequence; identical to SEQ ID NO: 26409
  derived and/or modified CDS sequence (AUadapt) from InfluenzaA__AHC61190__NA

SEQ ID NO: 26610 - RNA, 1410 nt, Artificial Sequence; identical to SEQ ID NO: 26422
  derived and/or modified CDS sequence (AUadapt) from InfluenzaA__AHC61202__NA

SEQ ID NO: 26611 - RNA, 1410 nt, Artificial Sequence; identical to SEQ ID NO: 26377
  derived and/or modified CDS sequence (AUadapt) from InfluenzaA__AHC61214__NA

SEQ ID NO: 26612 - RNA, 1410 nt, Artificial Sequence; identical to SEQ ID NO: 26422
  derived and/or modified CDS sequence (AUadapt) from InfluenzaA__AHC61226__NA

SEQ ID NO: 26613 - RNA, 1410 nt, Artificial Sequence; identical to SEQ ID NO: 26409
  derived and/or modified CDS sequence (AUadapt) from InfluenzaA__AHC61238__NA

SEQ ID NO: 26614 - RNA, 1410 nt, Artificial Sequence; identical to SEQ ID NO: 26590
  derived and/or modified CDS sequence (AUadapt) from InfluenzaA__AHC61250__NA

SEQ ID NO: 26615 - RNA, 1410 nt, Artificial Sequence; identical to SEQ ID NO: 26373
  derived and/or modified CDS sequence (AUadapt) from InfluenzaA__AHC61262__NA

SEQ ID NO: 26616 - RNA, 1410 nt, Artificial Sequence; identical to SEQ ID NO: 26377
  derived and/or modified CDS sequence (AUadapt) from InfluenzaA__AHC61274__NA

SEQ ID NO: 26617 - RNA, 1410 nt, Artificial Sequence; identical to SEQ ID NO: 21920
  derived and/or modified CDS sequence (AUadapt) from InfluenzaA__AHC61286__NA

SEQ ID NO: 26618 - RNA, 1410 nt, Artificial Sequence; identical to SEQ ID NO: 26421
  derived and/or modified CDS sequence (AUadapt) from InfluenzaA__AHC61298__NA

SEQ ID NO: 26619 - RNA, 1410 nt, Artificial Sequence
  derived and/or modified CDS sequence (AUadapt) from InfluenzaA__AHC61310__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcugcagaucaaccgccaggugaucaucgaccggggcaaccgguccggguacucgggcaucuucuccguggagggcaagagcugcaucaaccgcugcuucuacgucgagcucauccgggggcgcaaggaggagaccgaggugcuguggaccucguccagcaucguggucuucugcggcacguccgggaccuacggcaccgggagcuggccggacggcgccgaccugaaccucaugcccaucuga

SEQ ID NO: 26620 - RNA, 1410 nt, Artificial Sequence; identical to SEQ ID NO: 26450
  derived and/or modified CDS sequence (AUadapt) from InfluenzaA__AHC61322__NA

SEQ ID NO: 26621 - RNA, 1410 nt, Artificial Sequence; identical to SEQ ID NO: 26409
  derived and/or modified CDS sequence (AUadapt) from InfluenzaA__AHC61334__NA

SEQ ID NO: 26622 - RNA, 1410 nt, Artificial Sequence; identical to SEQ ID NO: 26377
  derived and/or modified CDS sequence (AUadapt) from InfluenzaA__AHC61346__NA

SEQ ID NO: 26623 - RNA, 1410 nt, Artificial Sequence
  derived and/or modified CDS sequence (AUadapt) from InfluenzaA__AHC61358__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacaucuccucguccagccacugccucgaccccaacaacgaggagggcgggcacggggucaagggcugggccuucgacgacgggaacgacguguggaugggccgcaccaucaacgagaccucccggcugggcuacgagaccuucaaggucaucaagggguggucgaaccccaaguccaagcugcagaucaaccgccaggugaucguggaccggggcaaccgcagcggguacuccggcaucuucucggucgaggggaaguccugcaucaaccggugcuucuacguggagcucauccgcggccggaaggaggagaccgaggugcuguggaccagcaacucgaucgucguguucugcggcacguccgggaccuacggcaccgggagcuggccggacggcgccgaccugaaccucaugcccaucuga

SEQ ID NO: 26624 - RNA, 1410 nt, Artificial Sequence; identical to SEQ ID NO: 26422
  derived and/or modified CDS sequence (AUadapt) from InfluenzaA__AHC61370__NA

SEQ ID NO: 26625 - RNA, 1410 nt, Artificial Sequence; identical to SEQ ID NO: 26450
  derived and/or modified CDS sequence (AUadapt) from InfluenzaA__AHC61382__NA

SEQ ID NO: 26626 - RNA, 1410 nt, Artificial Sequence; identical to SEQ ID NO: 26422
  derived and/or modified CDS sequence (AUadapt) from InfluenzaA__AHC61394__NA

SEQ ID NO: 26627 - RNA, 1410 nt, Artificial Sequence; identical to SEQ ID NO: 26450
  derived and/or modified CDS sequence (AUadapt) from InfluenzaA__AHC61406__NA

SEQ ID NO: 26628 - RNA, 1410 nt, Artificial Sequence; identical to SEQ ID NO: 26409
  derived and/or modified CDS sequence (AUadapt) from InfluenzaA__AHC61418__NA

SEQ ID NO: 26629 - RNA, 1410 nt, Artificial Sequence; identical to SEQ ID NO: 21920
  derived and/or modified CDS sequence (AUadapt) from InfluenzaA__AHC61430__NA

SEQ ID NO: 26630 - RNA, 1410 nt, Artificial Sequence; identical to SEQ ID NO: 26422
  derived and/or modified CDS sequence (AUadapt) from InfluenzaA__AHC61442__NA

SEQ ID NO: 26631 - RNA, 1410 nt, Artificial Sequence; identical to SEQ ID NO: 26422
  derived and/or modified CDS sequence (AUadapt) from InfluenzaA__AHC61454__NA

SEQ ID NO: 26632 - RNA, 1410 nt, Artificial Sequence
  derived and/or modified CDS sequence (AUadapt) from InfluenzaA__AHC61466__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaccaccgagaucguguaccucaccaacacgaccaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacgcaggagucggagugcgugugcaucaacgggaccugcaccguggucaugaccgacggguccgccagcggcaaggccgacacgaagauccucuucaucgaggagggcaagaucgugcacaccucgacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcggccacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggacaagggcaaccgguccggguacucgggcaucuucuccgucgagggcaagagcugcaucaaccgcugcuucuacguggagcucauccgggggcgcaaggaggagaccgaggugcuguggacgucgaacuccaucgucguguucugcggcaccagcgggaccuacggcaccggguccuggccggacggcgccgaccugaaccucaugcccaucuga

SEQ ID NO: 26633 - RNA, 1410 nt, Artificial Sequence; identical to SEQ ID NO: 26373
  derived and/or modified CDS sequence (AUadapt) from InfluenzaA__AHC61478__NA

SEQ ID NO: 26634 - RNA, 1410 nt, Artificial Sequence; identical to SEQ ID NO: 26409
  derived and/or modified CDS sequence (AUadapt) from InfluenzaA__AHC61490__NA

SEQ ID NO: 26635 - RNA, 1410 nt, Artificial Sequence; identical to SEQ ID NO: 26373
  derived and/or modified CDS sequence (AUadapt) from InfluenzaA__AHC61502__NA

SEQ ID NO: 26636 - RNA, 1410 nt, Artificial Sequence; identical to SEQ ID NO: 26422
  derived and/or modified CDS sequence (AUadapt) from InfluenzaA__AHC61514__NA

SEQ ID NO: 26637 - RNA, 1410 nt, Artificial Sequence; identical to SEQ ID NO: 25324
  derived and/or modified CDS sequence (AUadapt) from InfluenzaA__AHC61526__NA

SEQ ID NO: 26638 - RNA, 1410 nt, Artificial Sequence
  derived and/or modified CDS sequence (AUadapt) from InfluenzaA__AHC61538__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggaggggucgcacggcgucaaggggugggccuucgacgacggcaacgacguguggauggggcggaccaucaacgagaccucccgccugggcuacgagaccuucaaggucaucgagggcuggagcaaccccaaguccaagcugcagaucaaccgccaggugaucguggaccgggggaaccggucgggcuacuccgggaucuucagcgucgagggcaagucgugcaucaaccgcugcuucuacguggagcucauccgggggcgcaaggaggagaccgaggugcuguggaccuccaacagcaucgucguguucugcggcacguccggcaccuacgggaccggcagcuggccggacggggccgaccugaaccucaugcccaucuga

SEQ ID NO: 26639 - RNA, 1410 nt, Artificial Sequence; identical to SEQ ID NO: 26422
  derived and/or modified CDS sequence (AUadapt) from InfluenzaA__AHC61550__NA

SEQ ID NO: 26640 - RNA, 1410 nt, Artificial Sequence
  derived and/or modified CDS sequence (AUadapt) from InfluenzaA__AHC61562__NA
augaaccccaaccagaagaucaucaccaucggcucggugucccugaccaucagcacgaucugcuucuucaugcagaucgccauccucaucaccaccgucacccugcacuucaagcaguacgaguucuacuccccgcccaacaaccaggugaugcugugcgagcccacgaugaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccucgucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagucgaagcugcagaucaaccgccaggugaucguggaccggggcaaccgcuccggguacagcggcaucuucuccgucgagucgaagagcugcaucaaccggugcuucuacguggagcucauccgcgggcggaaggaggagaccgaggugcuguggaccuccaacagcaucgucguguucugcggcacguccggcaccuacgggaccggcaccuggccggacggggccgaccugaaccucaugcccaucuga

SEQ ID NO: 26641 - RNA, 1410 nt, Artificial Sequence; identical to SEQ ID NO: 26421
  derived and/or modified CDS sequence (AUadapt) from InfluenzaA__AHC61574__NA

SEQ ID NO: 26642 - RNA, 1410 nt, Artificial Sequence; identical to SEQ ID NO: 26422
  derived and/or modified CDS sequence (AUadapt) from InfluenzaA__AHC61586__NA

SEQ ID NO: 26643 - RNA, 1410 nt, Artificial Sequence; identical to SEQ ID NO: 25324
  derived and/or modified CDS sequence (AUadapt) from InfluenzaA__AHC61598__NA

SEQ ID NO: 26644 - RNA, 1410 nt, Artificial Sequence; identical to SEQ ID NO: 26373
  derived and/or modified CDS sequence (AUadapt) from InfluenzaA__AHC61610__NA

SEQ ID NO: 26645 - RNA, 1410 nt, Artificial Sequence; identical to SEQ ID NO: 26421
  derived and/or modified CDS sequence (AUadapt) from InfluenzaA__AHC61622__NA

SEQ ID NO: 26646 - RNA, 1410 nt, Artificial Sequence; identical to SEQ ID NO: 21920
  derived and/or modified CDS sequence (AUadapt) from InfluenzaA__AHC61634__NA

SEQ ID NO: 26647 - RNA, 1410 nt, Artificial Sequence; identical to SEQ ID NO: 21920
  derived and/or modified CDS sequence (AUadapt) from InfluenzaA__AHC61646__NA

SEQ ID NO: 26648 - RNA, 1410 nt, Artificial Sequence; identical to SEQ ID NO: 21920
  derived and/or modified CDS sequence (AUadapt) from InfluenzaA__AHC61658__NA

SEQ ID NO: 26649 - RNA, 1410 nt, Artificial Sequence; identical to SEQ ID NO: 25324
  derived and/or modified CDS sequence (AUadapt) from InfluenzaA__AHC61670__NA

SEQ ID NO: 26650 - RNA, 1410 nt, Artificial Sequence; identical to SEQ ID NO: 26377
  derived and/or modified CDS sequence (AUadapt) from InfluenzaA__AHC61682__NA

SEQ ID NO: 26651 - RNA, 1410 nt, Artificial Sequence; identical to SEQ ID NO: 25324
  derived and/or modified CDS sequence (AUadapt) from InfluenzaA__AHC61694__NA

SEQ ID NO: 26652 - RNA, 1410 nt, Artificial Sequence
  derived and/or modified CDS sequence (AUadapt) from InfluenzaA__AHC61706__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggagcacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggaccggggcaaccgcuccggguacucgggcaucuucuccgucgagggcaagagcugcaucaaccggugcuucuacguggagcucauccgcgggcggaaggaggagaccgaggugcuguggaccucgaacuccaucgucguguucugcggcacgagcgggaccuacggcaccggguccuggccggacggcgccgaccugaaccucaugcccaucuga

SEQ ID NO: 26653 - RNA, 1410 nt, Artificial Sequence
  derived and/or modified CDS sequence (AUadapt) from InfluenzaA__AHC61718__NA
augaaccccaaccagaagaucaucaccaucggcucggugucccugaccaucagcacgaucugcuucuucaugcagaucgccauccucaucaccaccgucacccugcacuucaagcagugcgaguucaacuccccgcccaacaaccaggugaugcugugcgagcccacgaucaucgagcgcaacaucaccgagaucguguaccucaccaacaccacgaucgagaaggagaucugccccaagcugaccgaguaccggaacuggucgaagccgcagugcgacaucaccggguucgcccccuucuccaaggacaacagcauccgccuguccgcgggcggggacaucugggucacccgggagcccuacgugucgugcgaccccaacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggagcuccucguccugccacgacgggaaggccuggcuccacgugugcaucaccggcgacgacaagaacgccaccgcgagcuucaucuacaacgggaagcugguggacuccguggucucgugguccaaggagauccugcggacgcaggagagcgagugcgugugcaucaacgggaccugcaccguggucaugaccgacggguccgccucgggcaaggccgacacgaagauccucuucaucgaggagggcaagaucgugcacaccagcacccuguccgggucggcccagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcggccacggggucaagggcugggcguucgacgacgggaacgacguguggaugggccggaccaucaacgagaccucgcgccugggcuacgagaccuucaaggucaucgaggggugguccaaccccaagagcaagcugcagaucaaccgccaggugaucguggaccggggcaaccgguccggguacucgggcaucuucuccgucgagggcaagagcugcaucaaccgcugcuucuacguggagcucauccgggggcgcaaggaggagaccggcgugcuguggacgucgaacuccaucgucguguucugcgggaccagcggcaccuacgggaccggcuccuggccggacggggccgaccugaaccucaugcccaucuga

SEQ ID NO: 26654 - RNA, 1410 nt, Artificial Sequence; identical to SEQ ID NO: 26373
  derived and/or modified CDS sequence (AUadapt) from InfluenzaA__AHC61730__NA

SEQ ID NO: 26655 - RNA, 1410 nt, Artificial Sequence; identical to SEQ ID NO: 26422
  derived and/or modified CDS sequence (AUadapt) from InfluenzaA__AHC61742__NA

SEQ ID NO: 26656 - RNA, 1410 nt, Artificial Sequence; identical to SEQ ID NO: 26373
  derived and/or modified CDS sequence (AUadapt) from InfluenzaA__AHC61754__NA

SEQ ID NO: 26657 - RNA, 1410 nt, Artificial Sequence; identical to SEQ ID NO: 21920
  derived and/or modified CDS sequence (AUadapt) from InfluenzaA__AHC61766__NA

SEQ ID NO: 26658 - RNA, 1410 nt, Artificial Sequence; identical to SEQ ID NO: 26409
  derived and/or modified CDS sequence (AUadapt) from InfluenzaA__AHC61778__NA

SEQ ID NO: 26659 - RNA, 1410 nt, Artificial Sequence; identical to SEQ ID NO: 26447
  derived and/or modified CDS sequence (AUadapt) from InfluenzaA__AHC61790__NA

SEQ ID NO: 26660 - RNA, 1410 nt, Artificial Sequence; identical to SEQ ID NO: 26377
  derived and/or modified CDS sequence (AUadapt) from InfluenzaA__AHC61802__NA

SEQ ID NO: 26661 - RNA, 1410 nt, Artificial Sequence; identical to SEQ ID NO: 26373
  derived and/or modified CDS sequence (AUadapt) from InfluenzaA__AHC61814__NA

SEQ ID NO: 26662 - RNA, 1410 nt, Artificial Sequence
  derived and/or modified CDS sequence (AUadapt) from InfluenzaA__AHC61826__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccagguggugcugugcgagcccacgaucaucgagcgcaacaucaccgagaucgucuaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggugacccgggagcccuacgugagcugcgacccggacaagugcuaccaguucgcccugggccaggggaccacgcucaacaacguccacuccaacaacaccgugcgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccgucgugagcugguccaaggagauccugcgcacccaggagucggagugcgugugcaucaacggcacgugcaccgucgugaugaccgacggguccgccagcggcaaggccgacaccaagauccuguucaucgaggagggcaagaucgugcacacgucgacccucuccgggagcgcgcagcacgucgaggagugcuccugcuacccccgguacccgggcgugcgcugcgugugccgggacaacuggaaggggucgaaccgccccaucgucgacaucaacaucaaggaccacuccaucgugagcuccuacgugugcucgggccuggucggcgacaccccgcggaagaacgacuccagcuccucgucccacugccuggaccccaacaacgaggagggcgggcacggggugaagggcugggccuucgacgacgggaacgacgucuggaugggccgcaccaucaacgagacgagccggcucggcuacgagaccuucaaggugaucgaggggugguccaaccccaagucgaagcugcagaucaaccgccaggugaucgucgaccgguccgaccgcagcggcuacuccgggaucuucucgguggagggcaagagcugcaucaaccggugcuucuacguggagcugauccgcgggcggaaggaggagaccgagguccucuggaccuccaacucgaucgugguguucugcggcacguccggcaccuacgggaccggcagcuggcccgacggggccgaccugaaccugaugcccaucuga

SEQ ID NO: 26663 - RNA, 1410 nt, Artificial Sequence; identical to SEQ ID NO: 26373
  derived and/or modified CDS sequence (AUadapt) from InfluenzaA__AHC61838__NA

SEQ ID NO: 26664 - RNA, 1410 nt, Artificial Sequence; identical to SEQ ID NO: 26409
  derived and/or modified CDS sequence (AUadapt) from InfluenzaA__AHC61850__NA

SEQ ID NO: 26665 - RNA, 1410 nt, Artificial Sequence; identical to SEQ ID NO: 26422
  derived and/or modified CDS sequence (AUadapt) from InfluenzaA__AHC61862__NA

SEQ ID NO: 26666 - RNA, 1410 nt, Artificial Sequence; identical to SEQ ID NO: 26373
  derived and/or modified CDS sequence (AUadapt) from InfluenzaA__AHC61874__NA

SEQ ID NO: 26667 - RNA, 1410 nt, Artificial Sequence
  derived and/or modified CDS sequence (AUadapt) from InfluenzaA__AHC61886__NA
augaaccccaaccagaagaucaucaccaucggcucggugucccugaccaucucgacgaucugcuucuucaugcagaucgccauccucaucaccaccgucacccugcacuucaagcaguacgaguucaacccgccgcccaacaaccagguggugcugugcgagcccacgaucaucgagcgcaacaucaccgagaucgucuaccucaccaacaccacgaucgagaaggagaucugccccaagcccgccgaguaccggcacugguccaagccccagugcgacaucaccggguucgcgcccuucagcaaggacaacuccauccgccugucggccggcggggacaucugggugacccgggagccguacguguccugcgaccccgacaagugcuaccaguucgcccugggccaggggaccacgcucaacaacguccacagcaacaacaccgugcgcgaccggacccccuaccgcacccugcugaugaacgagcucggcgugcccuuccaccugggcacgaagcaggucugcaucgccugguccucguccucgugccacgacgggaaggccuggcugcacgugugcaucaccggcgacgacaagaacgcgaccgccuccuucaucuacaacgggcggcucguggacagcgucguguccuggucgaaggagauccugcgcacccaggaguccgagugcgugugcaucaacggcacgugcaccgucgugaugaccgacgggagcgccuccggcaaggccgacaccaagauccuguucaucgaggagggcaagaucgugcacacgucgacccucagcggguccgcgcagcacgucgaggagugcucgugcuacccgcgguaccccggcgugcgcugcgugugccgggacaacuggaagggguccaaccgccccaucgucgacaucaacaucaaggaccacucgaucguguccagcuacgugugcuccggccuggucggcgacacgccccggaagaacgacucguccagcuccucgcacugccuggacccgaacaacgaggagggcgggcacggggugaagggcugggccuucgacgacgggaacgacgucuggaugggccgcaccaucaacgagaccucccggcucggcuacgagaccuucaaggugaucgagggguggucgaaccccaaguccaagcugcagaucaaccgccaggugaucgucgaccggggcgaccgcagcggguacuccggcaucuucucgguggaggggaaguccugcaucaaccggugcuucuacguggagcugauccgcggccggaaggaggagaccgagguccucuggaccagcaacucgaucgugguguucugcggcacguccgggaccuacggcaccgggagcuggcccgacggcgccgaccugaaccugaugcccaucuga

SEQ ID NO: 26668 - RNA, 1410 nt, Artificial Sequence; identical to SEQ ID NO: 26377
  derived and/or modified CDS sequence (AUadapt) from InfluenzaA__AHC61898__NA

SEQ ID NO: 26669 - RNA, 1410 nt, Artificial Sequence; identical to SEQ ID NO: 26409
  derived and/or modified CDS sequence (AUadapt) from InfluenzaA__AHC61910__NA

SEQ ID NO: 26670 - RNA, 1410 nt, Artificial Sequence; identical to SEQ ID NO: 21920
  derived and/or modified CDS sequence (AUadapt) from InfluenzaA__AHC61934__NA

SEQ ID NO: 26671 - RNA, 1410 nt, Artificial Sequence
  derived and/or modified CDS sequence (AUadapt) from InfluenzaA__AHC61946__NA
augaaccccaaccagaagaucaucaccaucggcucggugucccugaccaucucgacgaucugcuucuucaugcagaucgccauccucaucaccaccgucacccugcacuucaagcaguacgaguccuacagcccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucucgaaggacaacuccauccgccugagcgccggcggggacaucugggucacccgggagcccuacguguccugcgaccccgacaagugcuaccaguucgcccucggccaggggaccacgcugaacaacgugcacucgaacaacaccguccgcgaccggaccccguaccgcacccugcucaugaacgagcugggcgugcccuuccaccugggcacgaagcaggucugcaucgccugguccagcuccucgugccacgacgggaaggccuggcuccacgugugcaucaccggcgacgacaagaacgcgaccgccuccuucaucuacaacgggcggcugguggacucgguggucuccuggagcaaggagauccugcgcacccaggaguccgagugcgugugcaucaacggcacgugcaccguggucaugaccgacgggucggccagcggcaaggccgacaccaagauccucuucaucgaggagggcaagaucgugcacacguccacccugucgggguccgcgcagcacguggaggagugcagcugcuacccccggaaccccggcguccgcugcgugugccgggacaacuggaagggguccaaccgcccgaucguggacaucaacaucaaggaccacucgaucgucuccagcuacgugugcuccggccuggugggcgacacgccccggaagaacgacucguccucguccagccacugccucgaccccaacaacgaggagggcgggcacggggucaagggcugggccuucgacgacgggaacgacguguggaugggccgcaccaucaacgagaccucccggcugggcuacgagaccuucaaggucaucgagggguggucgaaccccaaguccaagcugcagaucaaccgccaggugaucguggaccggggcaaccgcagcggguacuccggcaucuucucggucgagggcaagagcugcaucaaccggugcuucuacguggagcucauccgcgggcggaaggaggagaccgaggugcuguggaccuccaacucgaucgucguguucugcggcacguccgggaccuacggcaccgggagcuggccggacggcgccgaccugaaccucaugcccaucuga

SEQ ID NO: 26672 - RNA, 1410 nt, Artificial Sequence; identical to SEQ ID NO: 25324
  derived and/or modified CDS sequence (AUadapt) from InfluenzaA__AHC61958__NA

SEQ ID NO: 26673 - RNA, 1410 nt, Artificial Sequence; identical to SEQ ID NO: 26373
  derived and/or modified CDS sequence (AUadapt) from InfluenzaA__AHC61970__NA

SEQ ID NO: 26674 - RNA, 1410 nt, Artificial Sequence
  derived and/or modified CDS sequence (AUadapt) from InfluenzaA__AHC61982__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacccaggagucggagugcgugugcaucaacggcacgugcgccguggucaugaccgacggguccgccagcggcaaggcggacaccaagauccucuucaucgaggagggcaagaucgugcacaccucgacgcuguccgggucggcccagcacguggaggagugcuccugcuacccccgguaccccggcguccgcugcgugugccgggacaacuggaaggggagcaaccgcccgaucguggacaucaacaucaaggaccacggcaucgucuccucguacgugugcuccggccuggugggggacacgccccggaagaacgacagcuccucguccagccacugccucgaccccaacaacgaggagggcgggcacggcgucaaggggugggccuucgacgacggcaacgacguguggaugggccgcaccaucaacgagaccucccggcugggguacgagaccuucaaggucaucgagggcuggucgaaccccaaguccaagcugcagaucaaccgccaggugaucguggaccgggggaaccgcagcggcuacuccgggaucuucucggucgagggcaaguccugcaucaaccggugcuucuacguggagcucauccgcggccggaaggaggagaccgaggugcuguggaccagcaacucgaucgucguguucugcgggaccuccggcacguacgggaccggcagcuggccggacggggccgaccugaaccucaugcccaucuga

SEQ ID NO: 26675 - RNA, 1410 nt, Artificial Sequence; identical to SEQ ID NO: 26377
  derived and/or modified CDS sequence (AUadapt) from InfluenzaA__AHC61994__NA

SEQ ID NO: 26676 - RNA, 1410 nt, Artificial Sequence; identical to SEQ ID NO: 26409
  derived and/or modified CDS sequence (AUadapt) from InfluenzaA__AHC62006__NA

SEQ ID NO: 26677 - RNA, 1410 nt, Artificial Sequence; identical to SEQ ID NO: 26373
  derived and/or modified CDS sequence (AUadapt) from InfluenzaA__AHC62018__NA

SEQ ID NO: 26678 - RNA, 1410 nt, Artificial Sequence; identical to SEQ ID NO: 25324
  derived and/or modified CDS sequence (AUadapt) from InfluenzaA__AHC62030__NA

SEQ ID NO: 26679 - RNA, 1410 nt, Artificial Sequence; identical to SEQ ID NO: 26377
  derived and/or modified CDS sequence (AUadapt) from InfluenzaA__AHC62042__NA

SEQ ID NO: 26680 - RNA, 1410 nt, Artificial Sequence; identical to SEQ ID NO: 26450
  derived and/or modified CDS sequence (AUadapt) from InfluenzaA__AHC62053__NA

SEQ ID NO: 26681 - RNA, 1410 nt, Artificial Sequence
  derived and/or modified CDS sequence (AUadapt) from InfluenzaA__AHC62065__NA
augaaccccaaccagaagaucaucaccaucggcucggugucccugaccaucucgacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggugacccgggagcccuacgugagcugcgacccggacaagugcuaccaguucgcccugggccaggggaccacgcucaacaacguccacuccaacaacaccgugcgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccgucgugagcugguccaaggagauccugcgcacccaggagucggagugcgugugcaucaacggcacgugcaccgucgugaugaccgacggguccgccagcggcaaggccgacaccaagauccuguucaucgaggagggcaagaucgugcacacgucgacccucuccgggucggcgcagcacgucgaggagugcuccugcuacccccgguacccgggcgugcgcugcgugugccgggacaacuggaaggggagcaaccgccccaucgucgacaucaacaucaaggaccacuccaucgugucguccuacgugugcagcggccuggucggcgacaccccgcggaagaacgacuccucguccagcucccacugccuggaccccaacaacgaggagggcgggcacggggugaagggcugggccuucgacgacgggaacgacgucuggaugggccgcaccaucaacgagacgucgcggcucggcuacgagaccuucaaggugaucgaggggugguccaaccccaagagcaagcugcagaucaaccgccaggugaucgucgaccggggcgaccgcuccggguacucgggcaucuucuccguggagggcaagagcugcaucaaccggugcuucuacguggagcugauccgcgggcggaaggaggagaccgagguccucuggaccucgaacuccaucgugguguucugcggcacgagcgggaccuacggcaccggguccuggcccgacggcgccgaccugaaccugaugcccaucuga

SEQ ID NO: 26682 - RNA, 1410 nt, Artificial Sequence; identical to SEQ ID NO: 26508
  derived and/or modified CDS sequence (AUadapt) from InfluenzaA__AHC62077__NA

SEQ ID NO: 26683 - RNA, 1410 nt, Artificial Sequence; identical to SEQ ID NO: 26422
  derived and/or modified CDS sequence (AUadapt) from InfluenzaA__AHC62089__NA

SEQ ID NO: 26684 - RNA, 1410 nt, Artificial Sequence; identical to SEQ ID NO: 26373
  derived and/or modified CDS sequence (AUadapt) from InfluenzaA__AHC62101__NA

SEQ ID NO: 26685 - RNA, 1410 nt, Artificial Sequence; identical to SEQ ID NO: 26422
  derived and/or modified CDS sequence (AUadapt) from InfluenzaA__AHC62113__NA

SEQ ID NO: 26686 - RNA, 1410 nt, Artificial Sequence
  derived and/or modified CDS sequence (AUadapt) from InfluenzaA__AHC62125__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcugcagaucaaccgccaggugaucguggaccggggcaacaaguccggguacucgggcaucuucuccgucgagggcaagagcugcaucaaccggugcuucuacguggagcucauccgcgggcggaaggaggagaccgaggugcuguggaccucgaacuccaucgucguguucugcggcacgagcgggaccuacggcaccggguccuggccggacggcgccgaccugaaccucaugcccaucuga

SEQ ID NO: 26687 - RNA, 1410 nt, Artificial Sequence
  derived and/or modified CDS sequence (AUadapt) from InfluenzaA__AHC62137__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcucauccgcgggcggaaggaggagaccgaggugcuguggaccucgaacuccaucgucguguucugcggcacgagcgggaccuacggcaccggguccuggccggacggcgccgaccugaaccucaugcccaucuga

SEQ ID NO: 26688 - RNA, 1410 nt, Artificial Sequence
  derived and/or modified CDS sequence (AUadapt) from InfluenzaA__AHC62149__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggucggcgcagcacguggaggagugcuccugcuacccccgguacccgggcguccgcugcgugugccgggacaacuggaaggggagcaaccgccccaucguggacaucaacauccgggaccacuccaucgucucguccuacgugugcagcggccuggugggcgacaccccgcgcaagaacgacuccucguccagcucccacugccuggaccccaacaacgaggagggcgggcacggggucaagggcugggccuucgacgacgggaacgacguguggaugggccggaccaucaacgagacgucgcgccucggcuacgagaccuucaaggucaucgaggggugguccaaccccaagagcaagcugcagaucaaccgccaggugaucguggaccggggcgaccgguccggguacucgggcaucuucuccgucgagggcaagagcugcaucaaccgcugcuucuacguggagcugauccgggggcgcaaggaggagaccgaggugcucuggaccucgaacuccaucgucguguucugcggcacgagcgggaccuacggcaccggguccuggcccgacggcgccgaccugaaccugaugcccaucuga

SEQ ID NO: 26689 - RNA, 1410 nt, Artificial Sequence; identical to SEQ ID NO: 26409
  derived and/or modified CDS sequence (AUadapt) from InfluenzaA__AHC62161__NA

SEQ ID NO: 26690 - RNA, 1410 nt, Artificial Sequence
  derived and/or modified CDS sequence (AUadapt) from InfluenzaA__AHC62173__NA
augaaccccaaccagaagaucaucaccaucggcucggugucccugaccaucagcacgaucugcuucuucaugcagaucgccauccucaucaccaccgucacccugcacuucaagcagugcgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcugcagaucaaccgccaggugaucguggaccggggcaaccgguccggguacucgggcaucuucuccgucgagggcaagagcugcaucaaccgcugcuucuacguggagcucauccgggggcgcaaggaggagaccgaggugcuguggaccucgaacuccaucgucguguucugcggcacgagcgggaccuacggcaccggguccuggccggacggcgccgaccugaaccucaugcccaucuga

SEQ ID NO: 26691 - RNA, 1410 nt, Artificial Sequence; identical to SEQ ID NO: 26422
  derived and/or modified CDS sequence (AUadapt) from InfluenzaA__AHC62185__NA

SEQ ID NO: 26692 - RNA, 1410 nt, Artificial Sequence; identical to SEQ ID NO: 25324
  derived and/or modified CDS sequence (AUadapt) from InfluenzaA__AHC62197__NA

SEQ ID NO: 26693 - RNA, 1410 nt, Artificial Sequence
  derived and/or modified CDS sequence (AUadapt) from InfluenzaA__AHC62209__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggucggcgcagcacguggaggagugcuccugcuacccccgguacccgggcguccgcugcgugugccgggacaacuggaaggggagcaaccgccccaucguggacaucaacaucaagaaccacuccaucgucucguccuacgugugcagcggccuggugggcgacaccccgcggaagaacgacuccucguccagcucccacugccuggaccccaacaacgaggagggcgggcacggggucaagggcugggccuucgacgacgggaacgacguguggaugggccgcaccaucaacgagacgucgcggcucggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcccaucuga

SEQ ID NO: 26694 - RNA, 1410 nt, Artificial Sequence; identical to SEQ ID NO: 26377
  derived and/or modified CDS sequence (AUadapt) from InfluenzaA__AHC62221__NA

SEQ ID NO: 26695 - RNA, 1410 nt, Artificial Sequence; identical to SEQ ID NO: 21920
  derived and/or modified CDS sequence (AUadapt) from InfluenzaA__AHC62233__NA

SEQ ID NO: 26696 - RNA, 1410 nt, Artificial Sequence; identical to SEQ ID NO: 26373
  derived and/or modified CDS sequence (AUadapt) from InfluenzaA__AHC62245__NA

SEQ ID NO: 26697 - RNA, 1410 nt, Artificial Sequence
  derived and/or modified CDS sequence (AUadapt) from InfluenzaA__AHC62257__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcgggcacggggucaagggcugggccuucgacgacgggaacgacguguggaugggccgcaccaucaacgagacgucgcggcucggcuacgagaccuucaaggucaucgaggggugguccaaccccaagagcaagcugcagaucaaccgccaggugaucgugggccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 26698 - RNA, 1410 nt, Artificial Sequence; identical to SEQ ID NO: 26450
  derived and/or modified CDS sequence (AUadapt) from InfluenzaA__AHC62269__NA

SEQ ID NO: 26699 - RNA, 1410 nt, Artificial Sequence; identical to SEQ ID NO: 26422
  derived and/or modified CDS sequence (AUadapt) from InfluenzaA__AHC62281__NA

SEQ ID NO: 26700 - RNA, 1410 nt, Artificial Sequence; identical to SEQ ID NO: 26377
  derived and/or modified CDS sequence (AUadapt) from InfluenzaA__AHC62293__NA

SEQ ID NO: 26701 - RNA, 1410 nt, Artificial Sequence; identical to SEQ ID NO: 21920
  derived and/or modified CDS sequence (AUadapt) from InfluenzaA__AHC62305__NA

SEQ ID NO: 26702 - RNA, 1410 nt, Artificial Sequence; identical to SEQ ID NO: 26373
  derived and/or modified CDS sequence (AUadapt) from InfluenzaA__AHC62317__NA

SEQ ID NO: 26703 - RNA, 1410 nt, Artificial Sequence
  derived and/or modified CDS sequence (AUadapt) from InfluenzaA__AHC62329__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccucguccugccacgacgggaaggccuggcugcacgugugcaucaccggcgacgacaagaacgcgaccgccagcuucaucuacaacgggcggcucguggacuccguggucucgugguccaaggagauccugcgcacccaggagagcgagugcgugugcaucaacggcacgugcaccguggucaugaccgacggguccgccucgggcaaggccgacaccaagauccuguucaucgaggagggcaagaucgugcacacgagcacccucuccgggucggcgcagcacguggaggagugcuccugcuacccccgguacccgggcguccgcugcgugugccgggacaacuggaaggggucgaaccgccccaucguggacaucaacaucaaggaccacuccaucgucagcuccuacgugugcucgggccuggugggcgacaccccgcggaagaacgacuccagcuccucgucccacugccuggaccccaacaacgaggagggcgggcacggggucaagggcugggccuucgacgacgggaacgacguguggaugggccgcaccaucaacgagacgucgcggcucggcuacgagaccuucaaggucaucgaggggugguccaaccccaagagcaagcugcagaucaaccgccaggugaucgccgaccggggcgaccgcuccggguacucgggcaucuucuccguggagggcaagagcugcaucaaccggugcuucuacgucgagcugauccgcgggcggaaggaggagaccgaggugcucuggaccucgaacuccaucguggucuucugcggcacgagcgggaccuacggcaccggguccuggcccgacggcgccgaccugaaccugaugcccaucuga

SEQ ID NO: 26704 - RNA, 1410 nt, Artificial Sequence; identical to SEQ ID NO: 26373
  derived and/or modified CDS sequence (AUadapt) from InfluenzaA__AHC62341__NA

SEQ ID NO: 26705 - RNA, 1410 nt, Artificial Sequence
  derived and/or modified CDS sequence (AUadapt) from InfluenzaA__AHC62353__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaccgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggaccggggcaaccgcuccggguacucgggcaucuucuccgucgagggcaagagcugcaucaaccggugcuucuacguggagcucauccgcgggcggaaggaggagaccgaggugcuguggacgucgaacuccaucgucguguucugcggcaccagcgggaccuacggcaccggguccuggccggacggcgccgaccugaaccucaugcccaucuga

SEQ ID NO: 26706 - RNA, 1410 nt, Artificial Sequence; identical to SEQ ID NO: 26373
  derived and/or modified CDS sequence (AUadapt) from InfluenzaA__AHC62365__NA

SEQ ID NO: 26707 - RNA, 1410 nt, Artificial Sequence; identical to SEQ ID NO: 26590
  derived and/or modified CDS sequence (AUadapt) from InfluenzaA__AHC62377__NA

SEQ ID NO: 26708 - RNA, 1410 nt, Artificial Sequence; identical to SEQ ID NO: 26422
  derived and/or modified CDS sequence (AUadapt) from InfluenzaA__AHC62389__NA

SEQ ID NO: 26709 - RNA, 1410 nt, Artificial Sequence; identical to SEQ ID NO: 26422
  derived and/or modified CDS sequence (AUadapt) from InfluenzaA__AHC62401__NA

SEQ ID NO: 26710 - RNA, 1410 nt, Artificial Sequence; identical to SEQ ID NO: 26450
  derived and/or modified CDS sequence (AUadapt) from InfluenzaA__AHC62413__NA

SEQ ID NO: 26711 - RNA, 1410 nt, Artificial Sequence; identical to SEQ ID NO: 26508
  derived and/or modified CDS sequence (AUadapt) from InfluenzaA__AHC62425__NA

SEQ ID NO: 26712 - RNA, 1410 nt, Artificial Sequence; identical to SEQ ID NO: 21920
  derived and/or modified CDS sequence (AUadapt) from InfluenzaA__AHC62437__NA

SEQ ID NO: 26713 - RNA, 1410 nt, Artificial Sequence; identical to SEQ ID NO: 26422
  derived and/or modified CDS sequence (AUadapt) from InfluenzaA__AHC62449__NA

SEQ ID NO: 26714 - RNA, 1410 nt, Artificial Sequence; identical to SEQ ID NO: 26377
  derived and/or modified CDS sequence (AUadapt) from InfluenzaA__AHC62461__NA

SEQ ID NO: 26715 - RNA, 1410 nt, Artificial Sequence; identical to SEQ ID NO: 26373
  derived and/or modified CDS sequence (AUadapt) from InfluenzaA__AHC62473__NA

SEQ ID NO: 26716 - RNA, 1410 nt, Artificial Sequence; identical to SEQ ID NO: 16339
  derived and/or modified CDS sequence (AUadapt) from InfluenzaA__AHC62485__NA

SEQ ID NO: 26717 - RNA, 1410 nt, Artificial Sequence; identical to SEQ ID NO: 26422
  derived and/or modified CDS sequence (AUadapt) from InfluenzaA__AHC62509__NA

SEQ ID NO: 26718 - RNA, 1410 nt, Artificial Sequence
  derived and/or modified CDS sequence (AUadapt) from InfluenzaA__AHC62521__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcugcagaucaaccgccaggugaucguggaccggggcaaccgguccggguacucgggcaucuucuccgucgagggcaagagcugcaucaaccgcugcuucuacguggagcucauccgggggcgcaaggaggagaccgaggugcuguggaccucgaacuccaucaucgucuucugcggcacgagcgggaccuacggcaccggguccuggccggacggcgccgaccugaaccucaugcccaucuga

SEQ ID NO: 26719 - RNA, 1410 nt, Artificial Sequence
  derived and/or modified CDS sequence (AUadapt) from InfluenzaA__AHC62533__NA
augaaccccaaccagaagaucaucaccaucggcucggugucccugaccaucagcacgaucugcuucuucaugcaggucgccauccucaucaccaccgugacccugcacuucaagcaguacgaguucaacuccccgcccaacaaccaggugaugcugugcgagcccacgaucaucgagcgcaacaucaccgagauccucuaccugaccaacaccacgaucgagaaggagaucugccccaagcuggccgaguaccggaacuggucgaagccgcagugcgacaucaccggguucgcgcccuucuccaaggacaacagcauccgccucuccgccggcggggacaucugggucacccgggagcccuacgugucgugcgaccccgacaagugcuaccaguucgcccugggccaggggaccacgcugaacaacgugcacuccaacaacaccguccgcgaccggaccccguaccgcacccuccugaugaacgagcugggcgugcccuuccaccucggcacgaagcaggucugcaucgccuggagcuccucguccugccacgacgggaaggccuggcugcacgugugcaucaccggcgacgacaagaacgcgaccgccagcuucaucuacaacgggaagcugguggacuccguggucucgugguccaaggagauccuccggacccaggagagcgagugcgugugcaucaacggcacgugcaccguggucaugaccgacggguccgccucgggcaaggccgacaccaagauccuguucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccucgugggcgacacgccccgcaagaacgacuccucguccagcucccacugccuggaccccaacaacgaggagggcgggaacggggucaagggcugggccuucgacgacgggaacgacguguggaugggccggaccaucaacgagaccucgcgccugggcuacgagaccuucaaggucaucgaggggugguccaaccccaagagcaagcuccagaucaaccgccaggugaucguggaccggggcaaccgguccggguacucgggcaucuucuccgucgagggcaagagcugcaucaaccgcugcuucuacguggagcugauccgggggcgcaaggaggagaccgaggugcuguggaccucgaacuccaucgucguguucugcggcacgagcgggaccuacggcaccggguccuggccggacggcgccgaccucaaccugaugcccaucuga

SEQ ID NO: 26720 - RNA, 1410 nt, Artificial Sequence; identical to SEQ ID NO: 26577
  derived and/or modified CDS sequence (AUadapt) from InfluenzaA__AHC62545__NA

SEQ ID NO: 26721 - RNA, 1410 nt, Artificial Sequence; identical to SEQ ID NO: 26422
  derived and/or modified CDS sequence (AUadapt) from InfluenzaA__AHC62557__NA

SEQ ID NO: 26722 - RNA, 1410 nt, Artificial Sequence; identical to SEQ ID NO: 26373
  derived and/or modified CDS sequence (AUadapt) from InfluenzaA__AHC62569__NA

SEQ ID NO: 26723 - RNA, 1410 nt, Artificial Sequence; identical to SEQ ID NO: 26422
  derived and/or modified CDS sequence (AUadapt) from InfluenzaA__AHC62581__NA

SEQ ID NO: 26724 - RNA, 1410 nt, Artificial Sequence
  derived and/or modified CDS sequence (AUadapt) from InfluenzaA__AHC62593__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcgggaacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggaccggggcaaccgcuccggguacucgggcaucuucuccgucgagggcaagagcugcaucaaccggugcuucuacguggagcucauccgcgggcggaaggaggagaccgaggugcuguggaccucgaacuccaucgucguguucugcggcacgagcgggaccuacggcaccggguccuggccggacggcgccgaccugaaccucaugcccaucuga

SEQ ID NO: 26725 - RNA, 1410 nt, Artificial Sequence; identical to SEQ ID NO: 26409
  derived and/or modified CDS sequence (AUadapt) from InfluenzaA__AHC62605__NA

SEQ ID NO: 26726 - RNA, 1410 nt, Artificial Sequence
  derived and/or modified CDS sequence (AUadapt) from InfluenzaA__AHC62617__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcgcugcgagcccacgaucaucgagcggaacaucaccgagaucguguaccugaccaacaccacgaucgagaaggagaucugccccaagcucgccgaguaccgcaacuggagcaagccgcagugcgacaucaccggguucgcgcccuucuccaaggacaacucgauccggcuguccgccggcggggacaucugggucacccgcgagcccuacgugagcugcgaccccaacaagugcuaccaguucgcccugggccaggggaccacgcucaacaacgugcacuccaacaacaccguccgggaccgcaccccguaccggacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggaagcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccuggaccccaacaacgaggagggcgggcacggggucaagggcugggccuucgacgacgggaacgacguguggaugggccgcaccaucaacgagaccucgcggcucggcuacgagaccuucaaggucaucgaggggugguccaaccccaagagcaagcugcagaucaaccgccaggugaucguggaccggggcaaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggccggacggcgccgaccugaaccugaugcccaucuga

SEQ ID NO: 26727 - RNA, 1410 nt, Artificial Sequence; identical to SEQ ID NO: 26377
  derived and/or modified CDS sequence (AUadapt) from InfluenzaA__AHC62629__NA

SEQ ID NO: 26728 - RNA, 1410 nt, Artificial Sequence
  derived and/or modified CDS sequence (AUadapt) from InfluenzaA__AHC62641__NA
augaaccccaaccagaagaucaucaccaucggcucggugucccugaccaucagcacggucugcuucuucaugcaggucgccauccucaucaccaccgugacccugcacuucaagcaguacgaguucaacuccccgcccaacaaccaggugaugcugugcgagcccacgaucaucgagcgcaacaucaccgagauccucuaccugaccaacaccacgaucgagaaggagaucugccccaagcuggccgaguaccggaacuggucgaagccgcagugcgacaucaccggguucgcgcccuucuccaaggacaacagcauccgccucuccgccggcggggacaucugggugacccgggagcccuacgugucgugcgaccccgacaagugcuaccaguucgcccugggccaggggaccacgcugaacaacguccacuccaacaacaccgugcgcgaccggaccccguaccgcacccuccugaugaacgagcugggcgugcccuuccaccucggcacgaagcaggucugcaucgccuggagcuccucguccugccacgacgggaaggccuggcugcacgugugcaucaccggcgacgacaagaacgcgaccgccagcuucaucuacaacgggaagcugguggacuccgucgugucgugguccaaggagauccuccggacccaggagagcgagugcgugugcaucaacggcacgugcaccgucgugaugaccgacggguccgccucgggcaaggccgacaccaagauccuguucaucgaggagggcaagaucgugcacacgagcacccuguccgggucggcgcagcacgucgaggagugcuccugcuacccccgcuaccccggcgugcggugcgugugccgcgacaacuggaaggggagcaaccggccgaucgucgacaucaacaucaaggaccacuccaucgugucguccuacgugugcagcggccucgucggcgacacgccccgcaagaacgacuccucguccagcucccacugccuggaccccaacaacgaggagggcgggcacggggugaagggcugggccuucgacgacgggaacgacgucuggaugggccggaccaucaacgagaccucgcgccugggcuacgagaccuucaaggugaucgaggggugguccaaccccaagagcaagcuccagaucaaccgccaggugaucgucgaccggggcaaccgguccggguacucgggcaucuucuccguggagggcaagagcugcaucaaccgcugcuucuacguggagcugauccgggggcgcaaggaggagaccgagguccuguggaccucgaacuccaucgugguguucugcggcacgagcgggaccuacggcaccggguccuggccggacggcgccgaccucaaccugaugcccaucuga

SEQ ID NO: 26729 - RNA, 1410 nt, Artificial Sequence; identical to SEQ ID NO: 26377
  derived and/or modified CDS sequence (AUadapt) from InfluenzaA__AHC62653__NA

SEQ ID NO: 26730 - RNA, 1410 nt, Artificial Sequence; identical to SEQ ID NO: 26377
  derived and/or modified CDS sequence (AUadapt) from InfluenzaA__AHC62665__NA

SEQ ID NO: 26731 - RNA, 1410 nt, Artificial Sequence
  derived and/or modified CDS sequence (AUadapt) from InfluenzaA__AHC62677__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacaucuccucguccagccacugccucgaccccaacaacgaggagggcgggcacggggucaagggcugggccuucgacgacgggaacgacguguggaugggccggaccaucaacgagaccucccgccugggcuacgagaccuucaaggucaucgagggguggucgaaccccaaguccaagcugcagaucaaccgccaggugaucguggaccggggcaaccggagcggguacuccggcaucuucucggucgaggggaaguccugcaucaaccgcugcuucuacguggagcucauccggggccgcaaggaggagaccgaggugcuguggaccagcaacucgaucgucguguucugcggcacguccgggaccuacggcaccgggagcuggccggacggcgccgaccugaaccucaugcccaucuga

SEQ ID NO: 26732 - RNA, 1398 nt, Artificial Sequence
  derived and/or modified CDS sequence (AUadapt) from InfluenzaA__AHF20560__NA
augaaucccaaccagaagauccugugcaccucggccaccgccaucaucaucggcgcgaucacggugcucaucgggaucgccaaccugggccugaacaucgggcuccaccugaagccgggcugcaacugcucccacucgcagcccgagaccaccaacaccucccagacgaucaucaacaauuacuacaacgagaccaacaccaccaacauccagauggaggagcgcacgucgcggaacuucaacaaccugaccaaggggcucugcaccaucaacuccuggcacaucuauggcaaggacaacgccguccgcaucggcgagucguccgacgugcuggugacccgggagcccuacgucucgugcgaccccgacgagugccgcuucuacgcccugucccaggggacgaccauccggggcaagcacaguaacgggaccauccacgaccgcucccaguaccgggcccucaucucguggccgcuguccucgccgcccaccguguacaacucccgcguggagugcaucggcuggucguccacgucgugccacgacgggaagucccggaugaguaucugcaucucgggccccaacaacaacgcguccgccgucgugugguacaaccgccggcccguggccgagaucaacaccugggcccgcaacauccugcggacccaggagucggagugcgucugccacaauggcgugugccccguggucuucaccgacggguccgcgacgggccccgccgacacccgcaucuacuacuucaaggaggggaagauccucaagugggagucgcugaccggcaccgccaagcacaucgaggagugcuccugcuacggcgagcggacggggaucacgugcacgugucgcgacaacuggcagggcucgaaccggcccgugauccagaucgacccgguggccaugacccacaccucccaguacaucugcucgcccguccugaccgacaacccccgccccaacgacccgaacaucgggaaguguaacgaccccuaccccggcaacaacaacaacggggugaagggcuucuccuaccucgacggcgccaacaccuggcuggggcggaccaucucgaccgcgucccgcucgggcuaugagaugcugaaggugcccaacgcccucaccgacgaccgguccaagccgauccaggggcagaccaucguccugaacgccgacuggucgggcuacuccgggucguucauggacuacugggccgagggcgacugcuaucgcgccugcuucuacguggagcugauccgcggccggcccaaggaggacaaggugugguggaccuccaacucgaucgucuccaugugcucgucgacggaguuccucgagcaguggaacuggcccgacggggcgaagaucgaguacuuccuguga

SEQ ID NO: 26733 - RNA, 1398 nt, Artificial Sequence; identical to SEQ ID NO: 16294
  derived and/or modified CDS sequence (AUadapt) from InfluenzaA__AHF20570__NA

SEQ ID NO: 26734 - RNA, 1413 nt, Artificial Sequence; identical to SEQ ID NO: 19034
  derived and/or modified CDS sequence (AUadapt) from InfluenzaA__AHG96111__NA

SEQ ID NO: 26735 - RNA, 1413 nt, Artificial Sequence; identical to SEQ ID NO: 19034
  derived and/or modified CDS sequence (AUadapt) from InfluenzaA__AHG96123__NA

SEQ ID NO: 26736 - RNA, 1413 nt, Artificial Sequence; identical to SEQ ID NO: 19034
  derived and/or modified CDS sequence (AUadapt) from InfluenzaA__AHG96135__NA

SEQ ID NO: 26737 - RNA, 1413 nt, Artificial Sequence; identical to SEQ ID NO: 19034
  derived and/or modified CDS sequence (AUadapt) from InfluenzaA__AHG96147__NA

SEQ ID NO: 26738 - RNA, 1413 nt, Artificial Sequence; identical to SEQ ID NO: 19034
  derived and/or modified CDS sequence (AUadapt) from InfluenzaA__AHG96159__NA

SEQ ID NO: 26739 - RNA, 1413 nt, Artificial Sequence; identical to SEQ ID NO: 19034
  derived and/or modified CDS sequence (AUadapt) from InfluenzaA__AHG96171__NA

SEQ ID NO: 26740 - RNA, 1413 nt, Artificial Sequence; identical to SEQ ID NO: 19034
  derived and/or modified CDS sequence (AUadapt) from InfluenzaA__AHG96183__NA

SEQ ID NO: 26741 - RNA, 1413 nt, Artificial Sequence; identical to SEQ ID NO: 19034
  derived and/or modified CDS sequence (AUadapt) from InfluenzaA__AHG96195__NA

SEQ ID NO: 26742 - RNA, 1413 nt, Artificial Sequence; identical to SEQ ID NO: 19034
  derived and/or modified CDS sequence (AUadapt) from InfluenzaA__AHG96207__NA

SEQ ID NO: 26743 - RNA, 1413 nt, Artificial Sequence; identical to SEQ ID NO: 19034
  derived and/or modified CDS sequence (AUadapt) from InfluenzaA__AHG96219__NA

SEQ ID NO: 26744 - RNA, 1413 nt, Artificial Sequence; identical to SEQ ID NO: 19034
  derived and/or modified CDS sequence (AUadapt) from InfluenzaA__AHG96231__NA

SEQ ID NO: 26745 - RNA, 1413 nt, Artificial Sequence; identical to SEQ ID NO: 19034
  derived and/or modified CDS sequence (AUadapt) from InfluenzaA__AHG96243__NA

SEQ ID NO: 26746 - RNA, 1413 nt, Artificial Sequence; identical to SEQ ID NO: 19034
  derived and/or modified CDS sequence (AUadapt) from InfluenzaA__AHG96255__NA

SEQ ID NO: 26747 - RNA, 1413 nt, Artificial Sequence; identical to SEQ ID NO: 19034
  derived and/or modified CDS sequence (AUadapt) from InfluenzaA__AHG96267__NA

SEQ ID NO: 26748 - RNA, 1413 nt, Artificial Sequence; identical to SEQ ID NO: 19034
  derived and/or modified CDS sequence (AUadapt) from InfluenzaA__AHG96279__NA

SEQ ID NO: 26749 - RNA, 1413 nt, Artificial Sequence; identical to SEQ ID NO: 19034
  derived and/or modified CDS sequence (AUadapt) from InfluenzaA__AHG96291__NA

SEQ ID NO: 26750 - RNA, 1413 nt, Artificial Sequence; identical to SEQ ID NO: 19034
  derived and/or modified CDS sequence (AUadapt) from InfluenzaA__AHG96303__NA

SEQ ID NO: 26751 - RNA, 1410 nt, Artificial Sequence; identical to SEQ ID NO: 18858
  derived and/or modified CDS sequence (AUadapt) from InfluenzaA__AHG96362__NA

SEQ ID NO: 26752 - RNA, 1410 nt, Artificial Sequence; identical to SEQ ID NO: 18858
  derived and/or modified CDS sequence (AUadapt) from InfluenzaA__AHG96374__NA

SEQ ID NO: 26753 - RNA, 1410 nt, Artificial Sequence; identical to SEQ ID NO: 18858
  derived and/or modified CDS sequence (AUadapt) from InfluenzaA__AHG96386__NA

SEQ ID NO: 26754 - RNA, 1413 nt, Artificial Sequence; identical to SEQ ID NO: 19034
  derived and/or modified CDS sequence (AUadapt) from InfluenzaA__AHG96398__NA

SEQ ID NO: 26755 - RNA, 1410 nt, Artificial Sequence; identical to SEQ ID NO: 18858
  derived and/or modified CDS sequence (AUadapt) from InfluenzaA__AHG96410__NA

SEQ ID NO: 26756 - RNA, 1410 nt, Artificial Sequence; identical to SEQ ID NO: 18858
  derived and/or modified CDS sequence (AUadapt) from InfluenzaA__AHG96422__NA

SEQ ID NO: 26757 - RNA, 1410 nt, Artificial Sequence; identical to SEQ ID NO: 18858
  derived and/or modified CDS sequence (AUadapt) from InfluenzaA__AHG96434__NA

SEQ ID NO: 26758 - RNA, 1410 nt, Artificial Sequence; identical to SEQ ID NO: 18858
  derived and/or modified CDS sequence (AUadapt) from InfluenzaA__AHG96446__NA

SEQ ID NO: 26759 - RNA, 1410 nt, Artificial Sequence; identical to SEQ ID NO: 18858
  derived and/or modified CDS sequence (AUadapt) from InfluenzaA__AHG96458__NA

SEQ ID NO: 26760 - RNA, 1410 nt, Artificial Sequence; identical to SEQ ID NO: 18858
  derived and/or modified CDS sequence (AUadapt) from InfluenzaA__AHG96470__NA

SEQ ID NO: 26761 - RNA, 1410 nt, Artificial Sequence; identical to SEQ ID NO: 18858
  derived and/or modified CDS sequence (AUadapt) from InfluenzaA__AHG96482__NA

SEQ ID NO: 26762 - RNA, 1410 nt, Artificial Sequence; identical to SEQ ID NO: 18858
  derived and/or modified CDS sequence (AUadapt) from InfluenzaA__AHG96494__NA

SEQ ID NO: 26763 - RNA, 1410 nt, Artificial Sequence; identical to SEQ ID NO: 18858
  derived and/or modified CDS sequence (AUadapt) from InfluenzaA__AHG96506__NA

SEQ ID NO: 26764 - RNA, 1413 nt, Artificial Sequence; identical to SEQ ID NO: 19034
  derived and/or modified CDS sequence (AUadapt) from InfluenzaA__AHG96518__NA

SEQ ID NO: 26765 - RNA, 1413 nt, Artificial Sequence; identical to SEQ ID NO: 19034
  derived and/or modified CDS sequence (AUadapt) from InfluenzaA__AHG96530__NA

SEQ ID NO: 26766 - RNA, 1413 nt, Artificial Sequence; identical to SEQ ID NO: 19034
  derived and/or modified CDS sequence (AUadapt) from InfluenzaA__AHG96542__NA

SEQ ID NO: 26767 - RNA, 1413 nt, Artificial Sequence; identical to SEQ ID NO: 19034
  derived and/or modified CDS sequence (AUadapt) from InfluenzaA__AHG96554__NA

SEQ ID NO: 26768 - RNA, 1413 nt, Artificial Sequence; identical to SEQ ID NO: 19034
  derived and/or modified CDS sequence (AUadapt) from InfluenzaA__AHG96566__NA

SEQ ID NO: 26769 - RNA, 1413 nt, Artificial Sequence; identical to SEQ ID NO: 19034
  derived and/or modified CDS sequence (AUadapt) from InfluenzaA__AHG96578__NA

SEQ ID NO: 26770 - RNA, 1413 nt, Artificial Sequence; identical to SEQ ID NO: 19034
  derived and/or modified CDS sequence (AUadapt) from InfluenzaA__AHG96590__NA

SEQ ID NO: 26771 - RNA, 1413 nt, Artificial Sequence; identical to SEQ ID NO: 19034
  derived and/or modified CDS sequence (AUadapt) from InfluenzaA__AHG96602__NA

SEQ ID NO: 26772 - RNA, 1413 nt, Artificial Sequence; identical to SEQ ID NO: 19034
  derived and/or modified CDS sequence (AUadapt) from InfluenzaA__AHG96614__NA

SEQ ID NO: 26773 - RNA, 1413 nt, Artificial Sequence; identical to SEQ ID NO: 19034
  derived and/or modified CDS sequence (AUadapt) from InfluenzaA__AHG96626__NA

SEQ ID NO: 26774 - RNA, 1413 nt, Artificial Sequence; identical to SEQ ID NO: 19034
  derived and/or modified CDS sequence (AUadapt) from InfluenzaA__AHG96638__NA

SEQ ID NO: 26775 - RNA, 1413 nt, Artificial Sequence; identical to SEQ ID NO: 19034
  derived and/or modified CDS sequence (AUadapt) from InfluenzaA__AHG96650__NA

SEQ ID NO: 26776 - RNA, 1413 nt, Artificial Sequence; identical to SEQ ID NO: 19034
  derived and/or modified CDS sequence (AUadapt) from InfluenzaA__AHG96662__NA

SEQ ID NO: 26777 - RNA, 1413 nt, Artificial Sequence; identical to SEQ ID NO: 19034
  derived and/or modified CDS sequence (AUadapt) from InfluenzaA__AHG96674__NA

SEQ ID NO: 26778 - RNA, 1413 nt, Artificial Sequence; identical to SEQ ID NO: 19034
  derived and/or modified CDS sequence (AUadapt) from InfluenzaA__AHG96686__NA

SEQ ID NO: 26779 - RNA, 1410 nt, Artificial Sequence; identical to SEQ ID NO: 18858
  derived and/or modified CDS sequence (AUadapt) from InfluenzaA__AHG96698__NA

SEQ ID NO: 26780 - RNA, 1410 nt, Artificial Sequence; identical to SEQ ID NO: 18858
  derived and/or modified CDS sequence (AUadapt) from InfluenzaA__AHG96710__NA

SEQ ID NO: 26781 - RNA, 1410 nt, Artificial Sequence; identical to SEQ ID NO: 18858
  derived and/or modified CDS sequence (AUadapt) from InfluenzaA__AHG96722__NA

SEQ ID NO: 26782 - RNA, 1410 nt, Artificial Sequence; identical to SEQ ID NO: 18858
  derived and/or modified CDS sequence (AUadapt) from InfluenzaA__AHG96734__NA

SEQ ID NO: 26783 - RNA, 1410 nt, Artificial Sequence; identical to SEQ ID NO: 18858
  derived and/or modified CDS sequence (AUadapt) from InfluenzaA__AHG96746__NA

SEQ ID NO: 26784 - RNA, 1410 nt, Artificial Sequence; identical to SEQ ID NO: 18858
  derived and/or modified CDS sequence (AUadapt) from InfluenzaA__AHG96758__NA

SEQ ID NO: 26785 - RNA, 1410 nt, Artificial Sequence; identical to SEQ ID NO: 18858
  derived and/or modified CDS sequence (AUadapt) from InfluenzaA__AHG96770__NA

SEQ ID NO: 26786 - RNA, 1410 nt, Artificial Sequence; identical to SEQ ID NO: 18858
  derived and/or modified CDS sequence (AUadapt) from InfluenzaA__AHG96782__NA

SEQ ID NO: 26787 - RNA, 1410 nt, Artificial Sequence; identical to SEQ ID NO: 18858
  derived and/or modified CDS sequence (AUadapt) from InfluenzaA__AHG96794__NA

SEQ ID NO: 26788 - RNA, 1410 nt, Artificial Sequence; identical to SEQ ID NO: 18858
  derived and/or modified CDS sequence (AUadapt) from InfluenzaA__AHG96806__NA

SEQ ID NO: 26789 - RNA, 1410 nt, Artificial Sequence; identical to SEQ ID NO: 18858
  derived and/or modified CDS sequence (AUadapt) from InfluenzaA__AHG96818__NA

SEQ ID NO: 26790 - RNA, 1410 nt, Artificial Sequence; identical to SEQ ID NO: 18858
  derived and/or modified CDS sequence (AUadapt) from InfluenzaA__AHG96830__NA

SEQ ID NO: 26791 - RNA, 1410 nt, Artificial Sequence; identical to SEQ ID NO: 18858
  derived and/or modified CDS sequence (AUadapt) from InfluenzaA__AHG96842__NA

SEQ ID NO: 26792 - RNA, 1410 nt, Artificial Sequence; identical to SEQ ID NO: 18858
  derived and/or modified CDS sequence (AUadapt) from InfluenzaA__AHG96854__NA

SEQ ID NO: 26793 - RNA, 1410 nt, Artificial Sequence; identical to SEQ ID NO: 18858
  derived and/or modified CDS sequence (AUadapt) from InfluenzaA__AHG96866__NA

SEQ ID NO: 26794 - RNA, 1410 nt, Artificial Sequence; identical to SEQ ID NO: 18858
  derived and/or modified CDS sequence (AUadapt) from InfluenzaA__AHG96878__NA

SEQ ID NO: 26795 - RNA, 1410 nt, Artificial Sequence; identical to SEQ ID NO: 18858
  derived and/or modified CDS sequence (AUadapt) from InfluenzaA__AHG96890__NA

SEQ ID NO: 26796 - RNA, 1410 nt, Artificial Sequence; identical to SEQ ID NO: 18858
  derived and/or modified CDS sequence (AUadapt) from InfluenzaA__AHG96902__NA

SEQ ID NO: 26797 - RNA, 1410 nt, Artificial Sequence; identical to SEQ ID NO: 18858
  derived and/or modified CDS sequence (AUadapt) from InfluenzaA__AHG96914__NA

SEQ ID NO: 26798 - RNA, 1410 nt, Artificial Sequence; identical to SEQ ID NO: 18858
  derived and/or modified CDS sequence (AUadapt) from InfluenzaA__AHG96926__NA

SEQ ID NO: 26799 - RNA, 1410 nt, Artificial Sequence; identical to SEQ ID NO: 18858
  derived and/or modified CDS sequence (AUadapt) from InfluenzaA__AHG96938__NA

SEQ ID NO: 26800 - RNA, 1410 nt, Artificial Sequence; identical to SEQ ID NO: 18858
  derived and/or modified CDS sequence (AUadapt) from InfluenzaA__AHG96950__NA

SEQ ID NO: 26801 - RNA, 1410 nt, Artificial Sequence; identical to SEQ ID NO: 18858
  derived and/or modified CDS sequence (AUadapt) from InfluenzaA__AHG96962__NA

SEQ ID NO: 26802 - RNA, 1410 nt, Artificial Sequence; identical to SEQ ID NO: 18858
  derived and/or modified CDS sequence (AUadapt) from InfluenzaA__AHG96974__NA

SEQ ID NO: 26803 - RNA, 1410 nt, Artificial Sequence; identical to SEQ ID NO: 18858
  derived and/or modified CDS sequence (AUadapt) from InfluenzaA__AHG96986__NA

SEQ ID NO: 26804 - RNA, 1410 nt, Artificial Sequence; identical to SEQ ID NO: 18858
  derived and/or modified CDS sequence (AUadapt) from InfluenzaA__AHG96998__NA

SEQ ID NO: 26805 - RNA, 1410 nt, Artificial Sequence; identical to SEQ ID NO: 18858
  derived and/or modified CDS sequence (AUadapt) from InfluenzaA__AHG97010__NA

SEQ ID NO: 26806 - RNA, 1410 nt, Artificial Sequence; identical to SEQ ID NO: 18858
  derived and/or modified CDS sequence (AUadapt) from InfluenzaA__AHG97022__NA

SEQ ID NO: 26807 - RNA, 1410 nt, Artificial Sequence; identical to SEQ ID NO: 18858
  derived and/or modified CDS sequence (AUadapt) from InfluenzaA__AHG97034__NA

SEQ ID NO: 26808 - RNA, 1410 nt, Artificial Sequence; identical to SEQ ID NO: 18858
  derived and/or modified CDS sequence (AUadapt) from InfluenzaA__AHG97046__NA

SEQ ID NO: 26809 - RNA, 1410 nt, Artificial Sequence
  derived and/or modified CDS sequence (AUadapt) from InfluenzaA__AHH00872__NA
augaaccccaaccagaagaucaucaccaucggcucggugucccugaccaucgccacgaucugcuuccucaugcagaucgccauccuggucaccaccgugacccugcacuucaagcaguacgagugcaacccgccgcccaacaaccaggugaugcucugcgagcccacgaucaucgagcgcaacaucaccgagaucgucuaccugaccaacaccacgaucgagaaggagaucugccccaagcuggcggaguaccggaacuggucgaagccccagugcaacaucaccggguucgcccccuucuccaaggacaacagcauccgccucuccgccggcggggacaucugggugacccgggagcccuacgugucgugcgacccggacaagugcuaccaguucgcccugggccaggggaccacgcugaacaacggccacuccaacgacaccguccacgaccgcacccccuaccggacccuccugaugaacgagcugggcgugcccuuccaccucgggacgaagcaggucugcaucgccuggucguccagcuccugccacgacggcaaggcguggcugcacgugugcgugaccggggacgacgagaacgccaccgccucguucaucuacaacggccgccugguggacuccaucgggucgugguccaagaagauccuccggacccaggagagcgagugcgucugcaucaacggcacgugcaccgugaucaugaccgacggcuccgccucggggaaggcggacaccaagauccuguucaucgaggagggcaagaucgugcacacgucgccccuguccgggagcgcccagcacgucgaggagugcuccugcuacccgcgcuaccccggcgugcggugcgugugccgcgacaacuggaagggcucgaaccggcccaucgucgacaucaacgugaaggacuacuccaucgugucguccuacgucugcagcgggcucgugggcgacacgccccgcaagaacgacuccucguccucgucccacugccuggacccgaacaacgaggagggcgggcacggggugaagggcugggccuucgacgacggcaacgacgucuggauggggcggaccaucagcgagaagucccgcucgggcuacgagaccuucaaggugaucgaggggugguccaagcccaacucgaagcugcagaucaaccggcaggucaucaucgaccgcggcaaccgguccggguacagcggcaucuucuccguggagggcaagucgugcaucaaccgcugcuucuacguggagcucauccgggggcgcaagcaggagaccgagguccuguggaccucgaacuccaucgugguguucugcggcaccagcgggaccuacggcacgggguccuggcccgacggcgccgaccugaaccucaugcccaucuga

SEQ ID NO: 26810 - RNA, 1416 nt, Artificial Sequence
  derived and/or modified CDS sequence (AUadapt) from InfluenzaA__AHI43497__NA
augaaucccaaccagaagcuguucgcccucucgggcguggccaucgcgcuguccauccugaaccuccugaucgggaucucgaacgucggccugaacaucucccuccaccugaaggggaagggcccgaagcaggaggagaaccugaccugcaccacgaucaaccagaacaacaccaccgugguggagaacaccuacgucaacaacacgaccaucaucaccaaggagaccgacuggaacacgcccucguaccuccugcugaauaagucccucugcaacguggagggguggguggucaucgccaaggacaacgccauccgcuucggcgagucggagcagaucaucgugacccgggagcccuacguguccugcgaccccaccggcugcaagauguacgcccugcaccaggggaccacgauccgcaacaagcacucgaacggcaccauccacgaccggaccgccuuccgcgggcugaucuccaccccgcucggcacgccgcccaccgucucgaacuccggguucaugugugugggcuggucguccacgaccugccacgacggcaucgggcggaugaccaucugcauccagggcaacaacgacaacgcgaccgccaccguguacuacaacgggcgccugaccacgaccaucaagaccugggcccggaacauccugcgcacccaggagucggagugcgucugccacaacggcacgugcgccguggugaugaccgacggcuccgcgucgucccaggccuacaccaaggucauguauuuccacaaggggcucgugaucaaggaggaggcccugcggggcucggcccgccacaucgaggagugcuccugcuacgggcacucgcagcgggugaccugcgucugccgcgacaacuggcagggcgccaaccggcccaucaucgagaucgacaugaacacgcuggagcacaccucgcgcuacgugugcaccgggauccucaccgacacgucccggcccggcgacaagaguuccggcgacugcucgaaccccaucaccgggucccccggcgcgcagggggugaagggcuucggguuccugaacggcgacaacaccuggcugggccgcaccaucucgccccggucccgcucgggguucgagaugcucaagaucccgaacgccggcaccgaccccaacucccggaucgccgagcgccaggagaucgucgacaacaacaacuggucgggguacuccggcucguuuaucgacuacuggaacaacaacuccgagugcuacaaccccugcuucuacguggagcugauccgggggcgccccgaggaggccaaguacgugugguggacgucgaacucccugaucgcccucugcggcucgccguuccccgucggcuccgggucguuccccgacggcgcgcagauccaguacuucuccuga

SEQ ID NO: 26811 - RNA, 1410 nt, Artificial Sequence
  derived and/or modified CDS sequence (AUadapt) from InfluenzaA__AHJ57439__NA
augaaccccaaccagaagaucaucaccaucggcucggugucccugaucaucagcaccaucugcuucuucaugcaggucgccauccuccugacgaccgugacccugcacuucaagcaguacgaguucaacuccccgcccaacaaccaggugaugcucugcgagcccaccaucaucgagcgcaacaucacggagaucgucuaccugaccaacaccaccaucgagaaggagaucugccccaagccggccgaguaccggaacuggucgaagccccagugcgacaucacgggguucgcgcccuucuccaaggacaacagcauccgccuguccgccggcggggacaucugggugacccgggagcccuacgugucgugcgacccggacaagugcuaccaguucgcccucggccaggggaccacccugaacaacguccacuccaacaacacggugcgcgaccggacccccuaccgcacccugcucaugaacgagcugggcgugcccuuccaccugggcaccaagcaggucugcaucgccuggagcuccucguccugccacgacgggaaggccuggcuccacgugugcaucacgggcgacgacaagaacgcgaccgccagcuucaucuacaacgggcggcugguggacuccgucgugucgugguccaaggacauccugcgcacccaggagagcgagugcgugugcaucaacgggaccugcacggucgugaugaccgacggguccgccucgggcaaggccgacaccaagauccucuucaucgaggagggcaagaucgugcacaccagcacgcuguccgggucggcgcagcacgucgaggagugcuccugcuacccccgguacccgggcgugcgcugcgugugccgggacaacuggaaggggagcaaccgccccaucgucgacaucaacaucaaggaccacuccaucgugucguccuacgugugcagcggccuggucggcgacaccccgcggaagaacgacuccucguccagcucccacugccucgaccccaacaacgaggagggcggccacggggugaagggcugggccuucgacgacgggaacgacgucuggaugggccgcaccaucaacgagaccucgcggcugggcuacgagacguucaaggugaucgaggggugguccaaccccaagagcaagcugcagaucaaccgccaggugaucgucgaccggggcaaccgcuccggguacucgggcaucuucuccguggagggcaagagcugcaucaaccggugcuucuacguggagcucauccgcgggcggaaggaggagaccgagguccuguggaccucgaacuccaucgugguguucugcggcaccagcgggacguacggcaccggguccuggcccgacggcgccgacaucaaccugaugcccaucuga

SEQ ID NO: 26812 - RNA, 1410 nt, Artificial Sequence
  derived and/or modified CDS sequence (AUadapt) from InfluenzaA__AHJ57440__NA
augaaccccaaccagaagaucaucaccaucggcucggugucccugaucaucucgaccaucugcuucuucaugcagaucgccauccucaucacgaccgucacccugcacuucaagcaguacgaguucaacuccccgcccaacaaccagaugaugcugugcgagcccaccaucaucgagcgcaacaucacggagaucguguaccucaccaacaccaccaucgagaaggagaucugccccaagccggccgaguaccggaacuggagcaagccccagugcgacaucacgggguucgcgcccuucuccaaggacaacucgauccgccuguccgccggcggggacaucugggugacccgggagcccuacgucagcugcgacccggacaagugcuaccaguucgcccugggccaggggaccacccucaacaacggccacuccaacaacacggugcgcgaccggacccccuaccgcacccugcugaugaacgagcucggcgugcccuuccaccuggggaccaagcaggucugcaucgccuggucguccagcuccugccacgacggcaaggccuggcugcacgugugcaucacgggggacgacaagaacgcgaccgccucguucaucuacaacggccggcucguggacuccgucgugagcugguccaaggagauccugcgcacccaggagucggagugcgugugcaucaacgggaccugcacggucgugaugaccgacggcuccgccagcggcaaggccgacaccaagauccuguucaucgaggaggggaagaucgugcacaccucgacgcucuccggcucggcgcagcacgucgaggagugcuccugcuacccccgguacccgggggugcgcugcgugugccgggacaacuggaagggcagcaaccgccccaucgucgacaucaacaucaaggaccacuccaucgugucguccuacgugugcagcggccuggucggggacaccccgcggaagaacgacuccucguccagcucccacugccuggaccccaacaacgaggagggcgggcacggcgugaaggggugggccuucgacgacggcaacgacguguggaugggccgcaccaucaacgagaccucgcggcucggguacgagacguucaaggucaucgagggcugguccaaccccaagagcaagcugcagaucaaccgccaggugaucgucgaccgcggggaccgguccggcuacucggggaucuucuccguggagggcaagagcugcaucaaccggugcuucuacguggagcugauccgcggccggaaggaggagaccgagguccucuggaccucgaacuccaucgugguguucugcgggaccagcggcacguacgggaccggcuccuggcccgacggggccgacaucaaccugaugcccaucuga

SEQ ID NO: 26813 - RNA, 1410 nt, Artificial Sequence
  derived and/or modified CDS sequence (AUadapt) from InfluenzaA__AHJ57441__NA
augaaccccaaccagaagaucaucaccaucggcucggugucccugaucaucucgaccaucugcuucuucaugcagaucgccauccucaucacgaccgucacccugcacuucaagcaguacgaguucaacuccccgcccaacaaccaggugaugcugugcgagcccaccaucaucgagcgcaacaagacggagaucguguaccucaccaacaccaccaucgagaaggagaucugccccaagccggccgaguaccggaacuggagcaagccccagugcgacaucacgggguucgcgcccuucuccaaggacaacucgauccgccuguccgccggcggggacaucugggucacccgggagcccuacgugagcugcgacccggacaagugcuaccaguucgcccugggccaggggaccacccucaacaacgugcacuccaacaacacgguccacgaccgcacccccuaccggacccugcugaugaacgagcucggcgugcccuuccaccugggcaccaagcaggucugcaucgccuggucguccagcuccugccacgacgggaaggccuggcugcacgugugcaucacgggcgacgacaagaacgcgaccgccucguucaucuacaacgggcgccucguggacuccguggucagcugguccaaggagauccugcggacccaggagucggagugcgugugcaucaacgggaccugcacgguggucaugaccgacggguccgccagcggcaaggccgacaccaagauccuguucaucgaggagggcaagaucgugcacaccucgacgcucuccgggucggcgcagcacguggaggagugcuccugcuacccccgcuacccgggcguccggugcgugugccgcgacaacuggaaggggagcaaccggcccaucguggacaucaacaucaaggaccacuccaucgucucguccuacgugugcagcggccuggugggcgacaccccgcgcaagaacgacuccucguccagcucccacugccuggaccccaacaacgaggagggcggccacggggucaagggcugggccuucgacgacgggaacgacguguggaugggccggaccaucaacgagaccucgcgccucggcuacgagacguucaaggucaucgaggggugguccaaccccaagagcaagcugcagaucaaccgccaggugaucguggaccggggcaaccgguccggguacucgggcaucuucuccgucgagggcaagagcugcaucaaccgcugcuucuacguggagcugauccgggggcgcaaggaggagaccgaggugcucuggaccucgaacuccaucgucguguucugcggcaccagcgggacguacggcaccggguccuggcccgacggcgccgacaucaaccugaugcccaucuga

SEQ ID NO: 26814 - RNA, 1413 nt, Artificial Sequence
  derived and/or modified CDS sequence (AUadapt) from InfluenzaA__AHJ57654__NA
augaaucccaaccagaagaucacgugcaucucggccaccggcaugacccuguccguggucucgcuccugaucgggaucgccaaccugggccucaacaucgggcugcacuacaagguguccgacucgaccaacaucaacaucccgaacaugaacgagaccucccccaccacgaccaucaucaacaaccacccccagaacaacuucaccaacaucaccaauaucaucaugaacaagaacgaggagggcaacuuccugaaccucacgaagccccugugcgaggugaacucguggcacauccuguccaaggacaacgcgauccgcaucggggagaacgcccacauccucgucacccgggagccguaccugucgugcgacccccagggcugccgcauguucgcccugucccagggcaccacccuccgggggcgccacgccaacggcacgauccacgaucggucgcccuuccgcgcccugaucuccugggagauggggcaggcgcccucgccguacaacgcccggguggagugcaucggcugguccucgaccuccugccacgacgggaucucgcgcauguccaucugcaucucgggccccaacaacaacgccuccgccguggucugguacggcgggcggcccgugaccgagauccccucgugggcgggcaacauccugcgcacccaggagucggagugcgugugccaugggggcaucugcccggucgugaugacggacggccccgccaacaaccgggccgagaccaagaucaucuacuucaaggaggggaaggugcagaagaucgaggagcucaagggcaacgcccagcacaucgaggagugcuccugcuacggggccucgggcaugaucaagugcaucugccgcgacaacuggaagggggcgaaccggcccgucaucaccaucgaccccgagaugaugacccacacguccaaguaccugugcucgaagauccugaccgauaccucccgcccgaacgaccccaccaacggcaacugcgacgcccccaucacgggcgggucgcccgacccgggcgugaagggguucgccuuccucgacggcgagaacuccuggcuggggcggaccaucucgaaggacucccgcucgggcuacgagaugcugaagauccccaacgccgagaccgacacccaguccggcgccaucucgcaccagaucaucgugaacaaccagaauugguccggguacucgggcgcguucaucgacuacugggccaacaaggagugcuucaaccccugcuucuacgucgagcucauccgggggcgccccaaggaguccucggugcuguggacguccaacucgaucguggcccugugcggcucccgggagcgccucgggucguggucguggcacgacggcgccgagaucaucuacuucaaguga

SEQ ID NO: 26815 - RNA, 1410 nt, Artificial Sequence
  derived and/or modified CDS sequence (AUadapt) from InfluenzaA__AHJ57666__NA
augaaccccaaccagaagaucaucaccaucggcucggugucccugaccaucgccacggucucguuccucaugcagaucgccauccugaccaccaccgugacgcugcacuucaagcacaacgagugcaacaugccgcccaagaaccaggugauguccugcgagcccaucaucaucgagcgcaacaucaccgagaucgucuaccucaacaacaccaccguggagaaggagaucugccccaagguggucgaguaccggaacuggagcaagccgcagugcaagaucacgggguucgcgcccuucuccaaggacaacucgauccgccuguccgccggcggggacaucugggugacccgggagcccuacgugagcugcggccuggggaagugcuaccaguucgcccucggccagggcaccacccuggacaacucccacucgaacgggacgauccacgaccgcaucccccaccggacccugcucaugaacgagcugggcgucccguuccaccuggggaccaagcaggucugcaucgccugguccucguccagcugccacgacggccgcgccuggcuccacaucugcaucaccggggacgaccggaacgcgacggccuccuucaucuacgacggcaugcugguggacucgaucggcuccuggagcaagaacauccugcgcacccaggaguccgagugcgugugcaucaacgggaccugcgccguggugaugaccgacggcucggccagcggggucgcggacacgcggauccucuucauccgcgagggcaagaucgugcacaucucgccccuguccggcuccgcccagcacaucgaggagugcucgugcuacccccgguaccccgacgugcgcugcgucugccgggacaacuggaagggguccaaccgcccggugaucgacaucaacauggccgacuacagcaucgacuccaacuacgugugcucgggccuggucggggacacgccccggaacgacgacaacuccagcuccucgaacugccgcgaccccaacaacgagcggggcaaccccggggugaagggcugggccuucgacgacggcaacgacguguggauggggcgcaccaucaaccgggacucccgcucgggcuacgagaccuuccgggucaucgggggcuggaccaccgccaacuccaagagccagaucaaccgccaggugaucgucgacaacaacaacugguccggguacucgggcguguucuccguggagggcaagagcugcaucaaccgcugcuucuacgucgagcucaucaaggggcggccgcaggagccccgcgugugguggaccucgaacuccaucguggucuucugcggcaccagcgggacguacggcaccggguccuggcccgacggcgcgaacaucaacuucaugcccaucuga

SEQ ID NO: 26816 - RNA, 1413 nt, Artificial Sequence
  derived and/or modified CDS sequence (AUadapt) from InfluenzaA__AHJ57677__NA
augaaucccaaccagaagaucacgugcaucucggccaccggcaugacccuguccguggucucgaugcucaucgggaucgccaaccugggccugaacaucgggcuccacuacaagguguccgacucgaccaacaucaacaucccgaacaugaacgagaccucccccaccacgaccgugaucaacaaccacccccagaacaacuucaccaacaucaccaauaucaucgucaacaagaacgaggaggagaacuuccugaaccugacgaagccccucugcgaggugaacucguggcacauccuguccaaggacaacgcgauccgcaucggcgagaacgcccacauccuggugacccgggagccguaccucucgugcgacccccaggggugccgcauguucgcccugucccagggcaccacccugcggggccagcacgccaacgggacgauccacgaucgcucgcccuuccgggcccucaucuccugggagaugggccaggcgcccucgccguacaacgcccgcgucgagugcaucgggugguccucgaccuccugccacgacggcaucucgcggauguccaucugcaucucggggcccaacaacaacgccuccgccguggugugguacggcggccgccccgucaccgagauccccucgugggcggggaacauccugcggacccaggagucggagugcgugugccauggcgggaucugcccgguggucaugacggacggccccgccaacaaccgcgccgagaccaagaucaucuacuucaaggagggcaagauccagaagguggaggagcugaaggggaacgcccagcacaucgaggagugcuccugcuacggcgccucggggaugaucaagugcaucugccgggacaacuggaagggcgcgaaccgccccgugaucaccaucgaccccgagaugaugacccacacguccaaguaccucugcaguaagauccugaccgacaccucccggccgaacgaccccaccaacgggaacugcgacgcccccaucacgggcggcucgcccgacccgggggucaagggcuucgccuuccuggacggggagaacuccuggcucggccgcaccaucucgaaggacucccggucgggguacgagaugcugaaggugcccaacgccgagaccgacacccaguccggcgccaucucgcaccagaugaucgugaacaaucagaacugguccggcuacucgggggcguucaucgacuacugggccaagaaggagugcuucaaccccugcuucuacgucgagcugauccgcggccggcccaaggaguccucggugcucuggacguccaacucgaucguggcccugugcgggucccgcgagcggcugggcucguggucguggcacgacggggccgagaucaucuacuucaaguga

SEQ ID NO: 26817 - RNA, 1413 nt, Artificial Sequence
  derived and/or modified CDS sequence (AUadapt) from InfluenzaA__AHJ57689__NA
augaaucccaaccagaagaucacgugcaucucggccaccggcaugacccuguccguggucucgaugcucaucgggaucgccaaccugggccugaacaucgggcuccacuacaagguguccgacucgaccaacaucaacaucccgaagaugaacgagaccucccccaccacgaccaucaucaacaaccacccccagaacaacuucaccaacaucaccaacaucaucgugaauaagaacgaggaggagaacuuccugaaccugacgaagccccucugcgaggucaacucguggcacauccuguccaaggacaacgcgauccgcaucggcgagaacgcccacauccuggugacccgggagccguaccucucgugcgacccccaggggugccgcauguucgcccugucccagggcaccacccugcggggccagcacgccaacgggacgauccacgaccgcagucccuuccgggcccucaucuccugggagaugggccaggcgcccucgccguacaacgcccgcguggagugcaucgggugguccucgaccuccugccacgacggcaucucgcggauguccaucugcaucucggggcccaacaacaacgccuccgccgucgugugguacggcggccgccccgugaccgagauccccucgugggcggggaacauccugcggacccaggagucggagugcgucugccacggcgggaucuguccgguggugaugacggacggccccgccaacaaccgcgccgagaccaagaucaucuacuucaaggagggcaagauccagaagaucgaggagcugaaggggaacgcccagcacaucgaggagugcuccugcuacggcgccucggggaugaucaagugcaucugccgggacaacuggaagggcgcgaaccgccccgucaucaccaucgaccccgagaugaugacccacacguccaaguaccucugcucgaagauccugaccgauaccucccggccgaacgaccccaccaacgggaacugcgacgcccccaucacgggcggcucgcccgacccgggggugaagggcuucgccuuccuggacggggagaacuccuggcucggccgcaccaucucgaaggacucccggucgggguacgagaugcugaaggugcccaacgccgagaccgacacccaguccggcgccaucucgcaccagaucaucgucaacaaccagaauugguccggcuacucgggggcguucaucgacuacugggccaacaaggagugcuucaaccccugcuucuacguggagcugauccgcggccggcccaaggaguccucggugcucuggacguccaacucgaucgucgcccugugcgggucccgcgagcggcugggcucguggucguggcacgacggggccgagaucaucuacuucaaguga

SEQ ID NO: 26818 - RNA, 1413 nt, Artificial Sequence
  derived and/or modified CDS sequence (AUadapt) from InfluenzaA__AHJ57700__NA
augaaucccaaccagaagaucacgugcaucucggccaccggcaugacccuguccguggucucgcuccugaucgggaucgccaaccugggccucaacaucgggcugcacuacaagguguccgacucgaccaacaucaacaucccgaacaugaacgagaccucccccaccacgaccaucaucaacaaccacccccagaacaacuucaccaacaucaccaauaucaucaugaacaagaacgaggagggcaacuuccugaaccucacgaagccccugugcgaggugaacucguggcacauccuguccaaggacaacgcgauccgcaucggggagaacgcccacauccucgucacccgggagccguaccugucgugcgacccccagggcugccgcauguucgcccugucccagggcaccacccuccgggggcgccacgccaacggcacgauccacgaucggucgcccuuccgcgcccugaucuccugggagauggggcaggcgcccucgccguacaacgcccggguggagugcaucggcugguccucgaccuccugccacgacgggaucucgcgcauguccaucugcaucucgggccccaacaacaacgccuccgccguggucugguacggcgggcggcccgugaccgagauccccucgugggcgggcaacauccugcgcacccaggagucggagugcgugugccaugggggcaucugcccggucgugaugacggacggccccgccaacaaccgggccgagaccaagaucaucuacuucaaggaggggaaggugcagaagaucgaggagcucaagggcaacgcccagcacaucgaggagugcuccugcuacggggccucgggcaugaucaagugcaucugccgcgacaacuggaagggggcgaaccggcccgucaucaccaucgaccccgagaugaugacccacacguccaaguaccugugcucgaagauccugaccgauaccucccgcccgaacgaccccaccaacggcaacugcgacgcccccaucacgggcgggucgcccgacccgggcgugaagggguucgccuuccucgacggcgagaacuccuggcuggggcggaccaucucgaaggacucccgcucgggcuacgagaugcugaaggugcccaacgccgagaccgacacccaguccggcgccaucucgcaccagaucaucgucaacaaccagaauugguccggguacucgggcgcguucaucgacuacugggccaacaaggagugcuucaaccccugcuucuacguggagcucauccgggggcgccccaaggaguccucggugcuguggacguccaacucgaucgucgcccugugcggcucccgggagcgccucgggucguggucguggcacgacggcgccgagaucaucuacuucaaguga

SEQ ID NO: 26819 - RNA, 1410 nt, Artificial Sequence
  derived and/or modified CDS sequence (AUadapt) from InfluenzaA__AHJ57710__NA
augaaccccaaccagaagaucaucaccaucggcucggugucccugaccaucgccacggucucguuccucaugcagaucgccauccugaccaccaccgugacgcugcacuucaagcacaacgagugcaacaugccgcccaagaaccaggugauguccugcgagcccaucaucaucgagcgcaacaucaccgagaucgucuaccucaacaacaccaccguggagaaggagaucugccccaagguggucgaguaccggaacuggagcaagccgcagugcaagaucacgggguucgcgcccuucuccaaggacaacucgauccgccuguccgccggcggggacaucugggugacccgggagcccuacgugagcugcggccuggggaagugcuaccaguucgcccucggccagggcaccacccuggacaacucccacucgaacgggacgauccacgaccgcaucccccaccggacccugcucaugaacgagcugggcgucccguuccaccuggggaccaagcaggucugcaucgccugguccagcuccucgugccacgacggccgcgccuggcuccacaucugcaucaccggggacgaccggaacgcgacggccuccuucaucuacgacggcaugcugguggacucgaucuccagcugguccaagaacauccugcgcacccaggagucggagugcgugugcaucaacgggaccugcgccguggugaugaccgacggcagcgccuccggcgucgcggacacgcggauccucuucauccgcgaggggaagaucgugcacaucucgccccuguccggcagcgcccagcacaucgaggagugcuccugcuacccccgguaccccgacgugcgcugcgucugccgggacaacuggaagggcucgaaccgcccggugaucaacaucaacauggccgacuacuccaucgacagcaacuacgugugcuccgggcuggucggcgacacgccccggaacgacgacaacucguccucguccaacugccgcgaccccaacaacgagcgggggaaccccggcgugaaggggugggccuucgacgacggcaacgacguguggaugggccgcaccaucaaccgggacagccgcuccggguacgagaccuuccgggucaucggcggguggaccaccgccaacucgaagucccagaucaaccgccaggugaucgucgacaacaacaacuggagcggcuacuccgggguguucucgguggagggcaagagcugcaucaaccgcugcuucuacgucgagcucauccggggccgcccgcaggagccccgggugugguggaccuccaacucgaucguggucuucugcgggaccuccggcacguacgggaccggcagcuggcccgacggggcgaacaucaacuucaugcccaucuga

SEQ ID NO: 26820 - RNA, 1410 nt, Artificial Sequence
  derived and/or modified CDS sequence (AUadapt) from InfluenzaA__AHJ57734__NA
augaaccccaaccagaagaucaucaccaucggcucggugucccugaccaucgccacggucucguuccucaugcagaucgccauccugaccaccaccgugacgcugcacuucaagcacaacgagugcaacaugccgcccaagaaccaggugauguccugcgagcccaucaucaucgagcgcaacaucaccgagaucgucuaccucaacaacaccaccguggagaaggagaucugccccaagguggcggaguaccggaacuggagcaagccgcagugcaagaucacgggguucgcccccuucuccaaggacaacucgauccgccuguccgccggcggggacaucugggucacccgggagcccuacgugucgugcggccuggggaagugcuaccaguucgcccucggccagggcaccacccuggacaacucccacagcaacgggacgauccacgaccgcaucccccaccggacccugcucaugaacgagcugggcgugccguuccaccuggggaccaagcaggucugcaucgccugguccucguccagcugccacgacggccgcgcguggcuccacaucugcaucaccggggacgaccggaacgccacggccuccuucaucuacgacggcaugcugguggacucgaucggcuccuggucgaagaacauccugcgcacccaggaguccgagugcgugugcaucaacgggaccugcgccgucgugaugaccgacggcagcgcgucggggguggccgacacgcggauccucuucauccgcgagggcaagaucguccacaucucgccccuguccggcuccgcccagcacaucgaggagugcagcugcuacccccgguaccccgacgugcgcugcgugugccgggacaacuggaagggguccaaccgcccggucaucaacaucaacauggccgacuacucgaucgacuccaacuacgugugcagcggccuggugggggacacgccccggaacgacgacaacuccucguccucgaacugccgcgaccccaacaacgagcggggcaaccccggggucaagggcugggccuucgacgacggcaacgacguguggauggggcgcaccaucaaccgggacucccgcagcggcuacgagaccuuccgggugaucgggggcuggaccaccgcgaacuccaagucgcagaucaaccgccaggucaucguggacaacaacaacugguccggguacucgggcgucuucuccguggagggcaagagcugcaucaaccgcugcuucuacguggagcucauccgggggcgcccgcaggagccccgggucugguggaccucgaacuccaucgugguguucugcggcaccagcgggacguacggcaccggguccuggcccgacggcgccaacaucaacuucaugcccaucuga

SEQ ID NO: 26821 - RNA, 1380 nt, Artificial Sequence
  derived and/or modified CDS sequence (AUadapt) from InfluenzaA__AHJ57746__NA
augaaucccaaccagaagaucaucaccaucggcucgguguccaucaccaucgccgccgucugcuuccugaugcagaucgcgauccucgccacgaccgugacccugcacuucaagcagaacgagugcaauaucccgagcaagaaccacgugauccccugcgagcccaucaucaucgagcgcaacaucaccgaggucgagauccggcccaagguggccgaguaccgcgacugguccaagccgcagugccagaucacgggguuugcccccuucagcaaggacaacuccauccggcugagcgccggcgggaacaucugggugacccgcgagcccuacgucuccugcggccccgacaaguguuaccaguucgcgcucgggcagggcaccacccugggcaacgggcacagcaacggcacgauccacgacaagaucccgcaucggacccugcucaugaacgagcugggggugcccuuccaccugggcaccaagcaggucugcaucgccugguccucguccagcugccacgaugggcgcgccuggcuccacgugugcgugaccggcgacgaccggaacgccacggcguccuucaucuacgacggcaugcugguggacaguaucgccuccuggagccagaacauccugcgcacccaggaguccgagugcgucugcaucaacgggaccugcaccguggugaugacggacggcagcgccuccggggucgccgauacccggauccucuucauccgcgagggcaagaucgugcacaucucgccccugagcggcuccgcccagcacaucgaggagugcagcugcuauccccggcacuccgacgugcgcugcgucugccgggacaacuggaaggggagcaaccgcccggugguggacaucaauaugaccgacuacuccaucgacagcuccuacgucugcucgggccuggugggggacacgccccggaaugacgacuccagcuccagcuccaacugccgcgaccccaacaaugagcggggcaaccccggggugaagggcugggcguucgacgacggcgacgacgucuggauggggcgcaccaucagccgggacucccgcagcggcuaugagaccuuccgggugaucgggggcuggaccaccgccaacuccaagucgcagaucaaccgccaggucaucguggacaacaacaacugguccggguauagcggcguguucagcgucgagggcaaguccugcaucaaccgcugcuucuacguggagcucauccgggggcgcccgcaggagacgcgggugugguggaccaguaacuccaucgucguguucugcggcaccagcgggaccuacggcacgggguccuggcccgacggcgccaacaucaacuucaugcccaucuga

SEQ ID NO: 26822 - RNA, 1410 nt, Artificial Sequence
  derived and/or modified CDS sequence (AUadapt) from InfluenzaA__AHJ57758__NA
augaaccccaaccagaagaucaucaccgugggcucggucucccuggccaucgccaccaucugccuccugaugcagaucgcgauccuggccacgaccgugacccuccacuucaagcagaacgagugcaacaucccgagcaagaaccaggugaugcccugcgagcccaucaucaucgagcgcaacaucaccgaggucguguaccugaacaacacgaucaucgagaaggagaucugccccaagguggucgaguaccggaacugguccaagccgcagugccagaucaccggguucgcccccuucucgaaggacaacuccauccgccugagcgccggcggggacaucugggugacccgggagcccuacguguccugcucgcccuccaagugcuaccaguucgcccucggccaggggaccacgcuggacaacagccacuccaacggcaccauccacgaccgcaucccgcaccggacccugcucaugaacgagcugggcguccccuuccaccuggggaccaagcaggucugcaucgcguggucguccagcuccugccacgacggccgcgccuggcuccacgugugcaucacgggggacgaccggaacgccaccgccucguucaucuacaacggcaugcugguggacuccaucagcuccuggucgcgcaacauccugcggacccaggagagcgagugcgugugcaucaacgggaccugcacggugaucaugaccgacggcuccgcgagcggcgucgccgacacccgcauccucuucauccgggaggggaacaucgugcacgugucgccccuguccggcuccgcccagcacaucgaggagugcagcugcuacccccgcuacccggacguccggugcgugugccgcgacaacuggaagggguccaaccggcccguggucgacaucaacauggccgacuacucgaucgacucccacuacgugugcagcggccuggugggcgacacgccccgcaacgacgacuccucguccagcuccaacugcaaggaccccaacaacgagcgggggaacccgggcgucaaggggugggccuucgacgacggcaacgacguguggauggggcgcaccaucucgcgggacucccgcagcggcuacgagaccuuccgggucaucggcggguggaccaccgcgaacuccaagucgcagaucaaccgccaggugaucguggacaacaacaacuggagcggcuacuccggggucuucucgguggagggcaaguccugcaucaaccgcugcuucuacguggagcucauccgggggcgcccccaggagacgcgggucugguggaccagcaacuccaucgugguguucugcggcaccagcggcaccuacgggacgggcuccuggcccgacggggccaacaucaacuucaugcccaucuga

SEQ ID NO: 26823 - RNA, 1401 nt, Artificial Sequence
  derived and/or modified CDS sequence (AUadapt) from InfluenzaA__AHJ57770__NA
augaaccccaaccagaagaucaucgccaucggcucggugucccugaccaucgccaucaucugcuuccucaugcagaucgcgauccugaccacgaccaugacccugcacuucaagcagaacgagugcucgaacccguccaacaaccaggucgugcccugcgagcccaucaucaucgagcgcaacaccgugcaccucaacagcacgaccaucgagaaggagaucugccccaaggucguggaguacaagaacugguccaagccgcagugccagaucaccggguucgcccccuucucgaaggacaacuccauccggcugucggccggcggggacaucugggugacccgcgagcccuacgucuccugcagccugggcaagugcuaccaguucgcccucgggcagggcacgacccugaagaacaagcacuccaacggcaccacccacgaccggaucccccaccgcacgcugcucaugaacgagcugggggugccguuccaccugggcaccaagcaggucugcaucgccuggucguccagcuccugcuacgacgggaaggcguggcuccacaucugcgugaccggcgacgacaagaacgccaccgccucgaucaucuacgacgggaugcugguggacuccaucggcucgugguccaagaacauccugcggacgcaggagagcgagugcgugugcaucaacgggaccugcgccgucgugaugaccgacggcucggcguccggcaaggccgacacccgcauccucuucauccgggaggggaagaucaucaacaucagcccccuguccggcucggcccagcacguggaggagugcuccugcuacccccgcuaccccgagguccggugcgugugccgcgacaacuggaagggcucgaaccggccggugcuguacaucaacauggccgacuacuccgucgagagcuccuacgugugcucggggcucgugggcgacacgccccgcaacgacgacuccucguccagcuccaacugccgggaccccaacaacgagcgcggggcccccggcgucaaggggugggcguucgacgacggcaacgacguguggaugggccggaccaucaagaacgacucgcgcuccggguacgagaccuuccggguggucaacggcuggaccacggccaacagcaagucccagaucaaccgccaggugaucgucgacucggagaacuggucgggguacuccggcaucuucagcguggaggggaagaacugcaucaaccggugcuucuacguggagcugauccgcggccggccgcaggagccccgcgucugguggaccuccaacucgaucaucguguucugcggcaccuccgggaccuacggcacggggagcuggcccgacggcgccaacaucaacuuccugcccaucuga

SEQ ID NO: 26824 - RNA, 1410 nt, Artificial Sequence
  derived and/or modified CDS sequence (AUadapt) from InfluenzaA__AHJ57782__NA
augaaccccaaccagaagaucaucaucaucggcucggugucccugaccaucgccaccgucugcuuccucaugcagaucgccauccuggcgacgaccgugacccugcacuucaagcagaacgagugcaacaucccgagcaagaaccaggugguccccugcgagcccaucaucaucgagcgcaacaucaccgaggugguguaccucaacaacacgaccaucgagaaggagaucugccccgccgucguggaguaccggaacugguccaagccgcagugccagaucaagggguucgcccccuucucgaaggacaacuccauccgccugagcgccggcggggacaugugggugacccgggagcccuacgucuccugcagccccuccaagugcuaccaguucgcccugggccaggggaccacgcucgacaacaaccacucgaacggcaccauccacgaccgcaucccgcaccggacccugcugaugaacgagcucggcgugcccuuccaccuggggaccaagcaggucugcaucgcgugguccagcuccucgugccacgacggcaaggccuggcugcacgugugcgugacgggggacgaccgcaacgccaccgccuccuucaucuacgacggcaugcucguggacagcaucggguccuggagccagaacauccugcggacccaggaguccgagugcgucugcaucaacgggaccugcacgguggugaugaccgacggcucggcgagcggcaucgccgacacccgcauccuguucguccgggagggcaagaucgugcacaucucgccccucuccggguccgcccagcacaucgaggagugcagcugcuacccccgcuacccggacgugcggugcgucugccgcgacaacuggaagggcuccaaccggcccaucguggacaucaacauggccgacuacagcaucggcuccucguacgugugcuccgggcuggucggcgacacgccccgcaacgacgaccgguucagcuccucgaacugccgcgaccccaacuccgagcgggggaacccgggcgugaaggggugggccuucgacgacggcgacgacgucuggaugggccgcaccaucagccgggacucccgcagcggguacgagaccuuccgggugaucggcggguggaccaccgcgaacuccaagucgcagaucaaccgccaggugaucgucgacaacaacaacugguccggcuacagcgggguguucucgguggagggcaaguccugcaucaaccgcugcuucuacgucgagcugauccggggccgcccccaggagacgcgggugugguggaccagcaacuccaucguggucuucugcgggaccagcggcaccuacgggacgggcuccuggcccgacggggccaacaucaacuucaugcccaucuga

SEQ ID NO: 26825 - RNA, 1410 nt, Artificial Sequence
  derived and/or modified CDS sequence (AUadapt) from InfluenzaA__AHJ57794__NA
augaaccccaaccagaagaucaucaccgugggcucggucucccuggccaucgccaccaucugcuuccucaugcagaucgcgauccuggccacgaccgugacccugcacuucaagcagaacgagugcaacaucccgagcaagaaccaggugaugcccugcgagcccaucaucaucgagcgcaacaucaccgaggucguguaccucaacaacacgaucaucgagaaggagaucugccccaagguggucgaguaccggaacugguccaagccgcagugccagaucaccggguucgcccccuucucgaaggacaacuccauccgccugagcgccggcggggacaucugggugacccgggagcccuacguguccugcucgcccuccaagugcuaccaguucgcccugggccaggggaccacgcucgacaacagccacuccaacggcaccauccacgaccgcaucccgcaccggacccugcugaugaacgagcucggcguccccuuccaccuggggaccaagcaggucugcaucgcguggucguccagcuccugccacgacggccgcgccuggcugcacgugugcaucacgggggacgaccggaacgccaccgccucguucaucuacaacggcaugcucguggacuccaucagcuccuggucgcgcaacauccugcggacccaggagagcgagugcgugugcaucaacgggaccugcacggugaucaugaccgacggcuccgcgucgggcgucgccgacacccgcauccuguucauccgggaggggaacaucgugcacgugagcccccucuccggcuccgcccagcacaucgaggagugcucgugcuacccccgcuacccggacguccggugcgugugccgcgacaacuggaagggguccaaccggcccguggucgacaucaacauggccgacuacagcaucgacucccacuacgugugcucgggccuggugggcgacacgccccgcaacgacgacuccagcuccucguccaacugcaaggaccccaacaacgagcgggggaacccgggcgucaaggggugggccagcgacgacggccacgacguguggauggggcgcaccaucggccgggacucccgcucgggcuacgagaccuuccgggucaucgggggcuggaccaccgcgaacuccaagagccagaucaaccgccaggugaucguggacaacaacaacuggucgggguacuccggcgucuucagcguggaggggaaguccugcaucaaccgcugcuucuacguggagcugauccggggccgcccccaggagacgcgggucugguggaccucgaacuccaucgugguguucugcggcaccagcgggaccuacggcacgggguccuggcccgacggcgccaacaucaacuucaugcccaucuga

SEQ ID NO: 26826 - RNA, 1413 nt, Artificial Sequence
  derived and/or modified CDS sequence (AUadapt) from InfluenzaA__AHJ57806__NA
augaaucccaaccagaagaucacgugcaucucggccaccggcaugacccuguccguggucucgcuccugaccgggaucgccaaccugggccucaacaucgggcugcacuacaagguguccgacucgaccaacaucuccaucccgaacaugaacgaggcgucgcccaccacgaccaucaucaacaaccacccccagaacaacuucaccaacaucaccaauaucaucaugaacaagaacgaggagggcaacuuccugaaccucacgaagccccugugcgaggugaacuccuggcacauccugucgaaggacaacgccauccgcaucggggagaacgcccacauccucgucacccgggagccguaccuguccugcgacccccagggcugccgcauguucgcccugucgcagggcaccacccuccgggggcgccacgccaacggcacgauccacgaucggucccccuuccgcgcgcugaucucgugggagauggggcaggcccccuccccguacaacgcccggguggagugcaucggcuggucguccaccucgugccacgacgggaucucccgcaugucgaucugcaucuccggccccaacaacaacgccucggcgguggucugguacggcgggcggcccgugaccgagauccccucgugggccggcaacauccugcgcacccaggaguccgagugcgugugccacgggggcaucuguccggucgugaugacggacggccccgccaacaaccgggccgagaccaagaucaucuacuucaaggaggggaagauccagaagaucgaggagcucaagggcaacgcccagcacaucgaggagugcucgugcuacggggcguccggcaugaucaagugcaucugccgcgacaacuggaagggggccaaccggcccgugaucaccaucgaccccgagaugaugacccacacgucgaaguaccugugcuccaagauccugaccgauaccucgcgcccgaacgaccccaccaacggcaacugcgacgcccccaucacgggcgggucccccgacccgggcgucaagggguucgccuuccucgacggcaagaacucguggcuggggcggaccaucuccaaggacucgcgcuccggcuacgagaugcugaaggugcccaacgccgagaccgacacccagucgggcgcgaucucccaccagaucaucgugaacaaccagaauuggucgggguacuccggcgccuucaucgacuacugggccaacaaggagugcuucaaccccugcuucuacgucgagcucauccgggggcgccccaaggagucguccgugcuguggacgucgaacuccaucguggcccugugcggcucgcgggagcgccucgggucgugguccuggcacgacggcgccgagaucaucuacuucaaguga

SEQ ID NO: 26827 - RNA, 1380 nt, Artificial Sequence
  derived and/or modified CDS sequence (AUadapt) from InfluenzaA__AHJ57818__NA
augaaucccaaccagaagaucacgugcaucucggccaccggcgugacgcuguccgucgugucgcuccugaucgggaucgccaaccugggccucaacaucgggcugcacuacaagguguccgacucgccgaccaucaauauccccaacaugaacgagaccaaccccaucaccacgaacaucaccaacaucaucgucaacaagaacgaggagggcaccuuccugaaccucaccaagccccugugcgaggugaacuccuggcauauccugucgaaggacaacgcgauccgcaucggggaggacgcccacauccucgugacgcgggagccguaccuguccugcgacccccagggcugccgcauguucgcccugagucagggcaccacccuccgggggcgccacgccaacggcaccauccacgaccggucccccuuccgcgcccugaucucgugggagauggggcaggcgcccuccccguacaacacgcgggucgagugcaucggcuggucguccaccucgugucacgacgggaucucccgcaugucgaucugcaucuccggccccaacaacaacgccucggccguggugugguaccggggccgccccgucaccgagauccccuccugggccgggaacauccugcggacccaggagagugagugcgugugccacaagggcaucugcccgguggucaugacggacgggcccgcgaacaacaaggccgccaccaagaucaucuacuucaaggagggcaagauccagaagaucgaggagcuccagggcaacgcccagcacaucgaggaguguucgugcuacggggccgcgggcaugaucaagugcgugugccgcgacaacuggaagggggccaaccggcccaucaucaccaucgaccccgagaugaugacccacacguccaaguaucugugcucgaagauccugaccgacaccucccgcccgaacgaccccaccgacggcaacugcgacgcccccaucaccgggggcucgcccgacccgggcgugaagggguuugccuuccucgagggcgagaacuccuggcuggggcggaccaucucgaaggacucccgcucgggcuacgagaugcugaagguccccaacgccgagaccgacacccaguccggggcgaucucgcaccagaugaucgugaauaaccagaacugguccggcuacucgggcgccuucaucgacuacugggccaacaaggagugcuucaaccccuguuucuacguggagcucauccgggggcgccccaaggaguccucgguccuguggacguccaacucgaucguggcccugugcggcucccgggagcgccucgggucgugguccuggcacgacggcgccgagaucaucuacuucaaguga

SEQ ID NO: 26828 - RNA, 1410 nt, Artificial Sequence
  derived and/or modified CDS sequence (AUadapt) from InfluenzaA__AHJ57830__NA
augaaccccaaccagaagaucaucaccaucggcucggugucccugaccaucgccacggucucguuccucaugcagaucgccauccugaccaccaccgugacgcugcacuucaagcacaacgagugcaacaugccgcccaagaaccaggugauguccugcgagcccaucaucaucgagcgcaacaucaccgagaucgucuaccucaacaacaccaccaucgagaaggagaucugccccaaggugguggaguaccggaacuggagcaagccgcagugcaagaucacgggguucgcgcccuucuccaaggacaacucgauccgccuguccgccggcggggacaucugggucacccgggagcccuacgugagcugcggccuggggaagugcuaccaguucgcccucggccagggcaccacccuggacaacucccacucgaacgggacgauccacgaccgcaucccccaccggacccugcucaugaacgagcugggcgugccguuccaccuggggaccaagcaggucugcaucgccugguccucguccagcugccacgacggccgcgccuggcuccacaucugcaucaccggggacgaccggaacgcgacggccuccuucaucuacgacggcaugcugguggacucgaucggcuccuggagcaagaacauccugcgcacccaggaguccgagugcgugugcaucaacgggaccugcgccgucgugaugaccgacggcucggccagcgggguggcggacacgcggauccucuucauccgcgagggcaagaucguccacaucucgccccuguccggcuccgcccagcacaucgaggagugcucgugcuacccccgguaccccgacgugcgcugcgugugccgggacaacuggaagggguccaaccgcccggucaucgacaucaacauggccgacuacagcaucgacuccaacuacgugugcucgggccuggugggggacacgccccggaacgacgacaacuccagcuccucgaacugccgcgaccccaacaacgagcggggcaaccccggggucaagggcugggccuucgacgacggcaacgacguguggauggggcgcaccaucaaccgggacucccgcucgggcuacgagaccuuccgggugaucgggggcuggaccaccgccaacuccaagagccagaucaaccgccaggucaucguggacaacaacaacugguccggguacucgggcgucuucuccguggagggcaagagcugcaucaaccgcugcuucuacguggagcucauccgggggcgcccgcaggagccccgggucugguggaccucgaacuccaucgugguguucugcggcaccagcgggacguacggcaccggguccuggcccgacggcgcgaacaucaacuucaugcccaucuga

SEQ ID NO: 26829 - RNA, 1413 nt, Artificial Sequence
  derived and/or modified CDS sequence (AUadapt) from InfluenzaA__AHJ57842__NA
augaaucccaaccagaagaucacgugcaucucggccaccggcaugacccuguccguggucucgaugcucaucgggaucgccaaccugggccugaacaucgggcuccacuacaagguguccgacucgaccaacaucaacaucccgaagaugaacgagaccaaccccaccacgaccaucaucaacaaccacccccagaacaacuucaccaacaucaccaauaucaucgugaacaagaacgaggaggagaacuuccugaaccugacgaagccccucugcgaggucaacuccuggcacauccugucgaaggacaacgcgauccgcaucggcgagaacgcccacauccuggugacccgggagccguaccucuccugcgacccccaggggugccgcauguucgcccugucgcagggcaccaccauccggggccagcacgccaacgggacgauccacgaucgcucccccuuccgggcccugaucucgugggagaugggccaggcgcccuccccguacaacgcccgcguggagugcaucggguggucguccaccucgugccacgacggcaucucccggaugucgaucugcaucuccgggcccaacaacaacgccucggccgucgugugguacggcggccgccccgugaccgagauccccuccugggcggggaacauccuccggacccaggagucggagugcgucugccacggcgggaucuguccgguggugaugacggacggccccgccaacaaccgcgccgagaccaagaucaucuacuucaaggagggcaagauccagaagaucgaggagcugaaggggaacgcccagcacaucgaggagugcucgugcuacggcgccuccgggaugaucaagugcaucugccgggacaacuggaagggcgcgaaccgccccgucaucaccaucgaccccgagaugaugacccacacgucgaaguaccugugcuccaagauccucaccgacaccagucggccgaacgaccccaccaacgggaacugcgacgcccccaucacgggcggcuccucggaccccggggugaagggcuucgccuuccuggacggggagaacuccuggcugggccgcaccaucucgaaggacucccggucgggguacgagaugcucaaggugccgaacgccgagaccgacacccaguccggcgccaucucgcaccagaucaucgucaacaaccagaauugguccggcuacucgggggcguucaucgacuacugggccaacaaggagugcuucaaccccugcuucuacguggagcugauccgcggccggcccaaggaguccucggugcuguggacguccaacucgaucgucgcccucugcgggucccgcgagcggcugggcucguggucguggcacgacggggccgagaucaucuacuucaaguga

SEQ ID NO: 26830 - RNA, 1413 nt, Artificial Sequence
  derived and/or modified CDS sequence (AUadapt) from InfluenzaA__AHJ57853__NA
augaaucccaaccagaagaucacgugcaucucggccaccggcaugacccuguccguggucucgcuccugaucgggaucgccaaccugggccucaacguggggcugcacuacaaggugaacgacccgaccaacaucaacauccccaacaugaacgagaccucccccaccacgaccaucaucaacaaccauccccagaacaacuucaccaacaucaccaacaucaucgucaacaagaacgaggaggagaacuuccugaaccucacgaagccgcugugcgaggugaacucguggcacauccuguccaaggacaacgcgauccgcaucggcgagaaugcccacauccucgugacccgggagcccuaccugucgugcgacccccaggggugccgcauguucgcccugucccagggcaccacccuccggggccagcacgccaacgggacgauccacgaccgcucgcccuuccgggcccugaucuccugggagaugggccaggcgccgucgcccuacaacgcccgcgucgaguguaucgggugguccucgaccuccugccacgacggcaucucgcggauguccaucugcaucucggggcccaacaacaacgccuccgccguggugugguacggcggccgccccgucaccgagaucccgucgugggcggggaacauccugcggacccaggaguccgagugcgugugccacggcgggaucugucccguggucaugacggacggccccgccaacaaccgcgccgagaccaagaucaucuacuucaaggagggcaagauccagaagaucgaggagcucaaggggaacgcccagcacaucgaggagugcucgugcuacggcgccucggggaugaucaagugcaucugccgggacaacuggaagggcgcgaaucgccccgugaucaccaucgacccggagaugaugacccacacguccaaguaccugugcucgaagauccugaccgacaccucccggcccaacgaccccaccaacgggaacugcgacgcccccaucacgggcggcucgccggaccccggggugaagggcuucgccuuccucgauggggagaacuccuggcugggccgcaccaucucgaaggacucccggucgggguacgagaugcugaagguccccaacgccgagaccgacacccaguccggcgccaucucgcaccagaugaucgugaacaaccagaacugguccggcuacucgggggcguucaucgacuauugggccaacaaggagugcuucaaccccugcuucuacguggagcucauccgcggccggccgaaggaguccucgguccuguggacguccaacucgaucguggcccugugcgggucccgcgagcggcucggcucgugguccuggcacgacggggccgagaucaucuacuucaaguga

SEQ ID NO: 26831 - RNA, 1413 nt, Artificial Sequence
  derived and/or modified CDS sequence (AUadapt) from InfluenzaA__AHJ57865__NA
augaaucccaaccagaagaucacgugcaucucggccaccggcaugacccuguccguggucucgaugcucaucgggaucgccaaccugggccugaacaucgggcuccacuacaagguguccgacucgaccaacaucaacaucccgaagaugaacgagaccaaccccaccacgaccaucaucaacaaccacccccagaacaauuucaccaacaucaccaacaucaucgugaacaagaacgaggaggagaacuuccugaaccugacgaagccccucugcgaggucaacuccuggcacauccugucgaaggacaacgcgauccgcaucggcgagaacgcccacauccuggugacccgggagccguaccucuccugcgauccccaggggugccgcauguucgcccugucgcagggcaccacccugcggggccgccacgccaacgggacgauccacgaccggucccccuuccgcgcccucaucucgugggagaugggccaggcgcccuccccguacaacgcccggguggagugcaucggguggucguccaccucgugccacgacggcaucucccgcaugucgaucugcaucuccgggcccaauaacaacgccucggccgucgugugguacggcggccggcccgugaccgagauccccuccugggcggggaacauccugcgcacccaggagucggagugcgucugccacggcgggaucugcccgguggugaugacggacggccccgccaacaaccgggccgagaccaagaucaucuacuucaaggagggcaagauccagaagaucgaggagcugaaggggaacgcccagcacaucgaggagugcaguugcuacggcgccuccgggaugaucaagugcaucugccgcgacaacuggaagggcgcgaaccggcccgucaucaccaucgaccccgagaugaugacccacacgucgaaguaccucugcuccaagauccugaccgacaccucgcgcccgaacgaccccaccaacgggaacugcgaugcccccaucacgggcggcucccccgacccgggggugaagggcuucgccuuccuggacggggagaacucguggcucggccggaccaucuccaaggacucgcgcuccggguacgagaugcugaaggugcccaacgccgagaccgacacccagucgggcgccaucucccaccagaugaucgucaacaaccagaacuggucgggcuacuccggggcguuuaucgacuacugggccaacaaggagugcuucaaccccugcuucuacguggagcugauccggggccgccccaaggagucguccgugcucuggacgucgaacuccaucgucgcccugugcgggucgcgggagcgccugggcuccuggucguggcacgacggggccgagaucaucuacuucaaguga

SEQ ID NO: 26832 - RNA, 1413 nt, Artificial Sequence
  derived and/or modified CDS sequence (AUadapt) from InfluenzaA__AHJ57876__NA
augaaucccaaccagaagaucacgugcaucucggccaccggcaugacccuguccguggucucgcuccugaucgggaucgccaaccugggccucaacaucgggcugcacuacaagguguccgacucgaccaacaucaacaucccgaacaugaacgagaccucccccaccacgaccaucaucaacaaccacccccagaacaauuucaccaacaucaccaacaucaucaugaacaagaacgaggagggcaacuuccugaaccucacgaagccccugugcgaggugaacucguggcacauccuguccaaggacaacgcgauccgcaucggggagaacgcccacauccucgucacccgggagccguaccugucgugcgauccccagggcugccgcauguucgcccugucccagggcaccacccuccgggggcgccacgccaacggcacgauccacgaccggucgcccuuccgcgcccugaucuccugggagauggggcaggcgcccucgccguacaacgcccggguggagugcaucggcugguccucgaccuccugccacgacggcaagucgcgcauguccaucugcaucagugggcccaacaacaacgccuccgccguggucugguacggcgggcggcccaucaccgagauccccucgugggcgggcaacauccugcgcacccaggagucggagugcgugugccacgggggcaucugcccgguggucaugacggacggccccgccaacaaccgggccgagaccaagaucaucuacuucaaggaggggaaggugcagaagaucgaggagcucaagggcaacgcccagcacaucgaggagugcuccuguuacggggccucgggcaugaucaagugcaucugccgcgacaacuggaagggggcgaaccggcccgugaucaccaucgaccccgagaugaugacccacacguccaaguaccugugcucgaagauccugaccgacaccucccgcccgaacgaccccaccaacggcaacugcgaugcccccaucacgggcgggucgcccgacccgggcgucaagggguucgccuuccucgacggcgagaacuccuggcuggggcggaccaucucgaaggacucccgcucgggcuacgagaugcugaaggugcccaacgccgagaccgacacccaguccggcgccaucucgcaccagaucaucgugaacaaccagaacugguccggguacucgggcgcguuuaucgacuacugggccaacaaggagugcuucaaccccugcuucuacgucgagcucauccgggggcgccccaaggaguccucggugcuguggacguccaacucgaucguggcccugugcggcucccgggagcgccucgggucguggucguggcacgacggcgccgagaucaucuacuucaaguga

SEQ ID NO: 26833 - RNA, 1413 nt, Artificial Sequence
  derived and/or modified CDS sequence (AUadapt) from InfluenzaA__AHJ57888__NA
augaaucccaaccagaagaucacgugcaucucggccaccggcaugacccuguccguggucucgaugcucaucgggaucgccaaccugggccugaacaucgggcuccacuacaagguguccgacucgaccaacaucaacaucccgaacaugaacgagaccucccccaccacgaccaucaccaacaaccacccccagaacaacuucaccaacaucacgaauaucaucgugucgaagaacgaggaggagaacuuccugaaccugaccaagccccucugcgaggucaacuccuggcacauccugucgaaggacaacgcgauccgcaucggcgagaacgcccacauccuggugacccgggagccguaccucuccugcgacccccaggggugccgcauguucgcccugucgcagggcaccacgcugcggggccagcacgccaacgggaccauccacgaucgcucccccuuccgggcccucaucucgugggagaugggccaggcgcccuccccguacaacgcccgcguggagugcaucggguggucguccaccucgugccacgacggcaucucccggaugucgaucugcaucuccgggcccaacaacaacgccucggccgucgugugguacggcggccgccccgugaccgagauccccucgugggcggggaacauccugcggacgcaggaguccgagugcgucugccacggcgggaucuguccgguggugaugaccgacggccccgccaacaaccgcgccgagaccaagaucaucuacuucaaggagggcaagauccagaagaucgaggagcugaaggggaacgcccagcacaucgaggagugcucgugcuacggcgccuccgggaugaucaagugcaucugccgggacaacuggaagggcgcgaaccgccccgucaucaccaucgaccccgagaugaugacgcacaccucgaaguaccucugcuccaagauccugaccgauaccucgcggccgaacgaccccacgaacgggaacugcgacgcccccaucaccggcggcucccccgacccgggggugaagggcuucgccuuccuggacggggagaacucguggcucggccgcaccaucuccaaggacucgcgguccggguacgagaugcugaaggugcccaacgccgagaccgacacgcagucgggcgccaucucccaccagaugaucgucaacaaccagaauuggucgggcuacuccggggcguucaucgacuacugggccaacaaggagugcuucaaccccugcuucuacguggagcugauccgcggccggcccaaggagucguccgugcucuggaccucgaacuccaucgucgcccugugcgggucgcgcgagcggcugggcucgugguccuggcacgacggggccgagaucaucuacuucaaguga

SEQ ID NO: 26834 - RNA, 1413 nt, Artificial Sequence
  derived and/or modified CDS sequence (AUadapt) from InfluenzaA__AHJ57900__NA
augaaucccaaccagaagaucacgugcaucucggccaccggcaugacccuguccguggucucgcuccugaucgggaucgccaaccugggccucaacaucgggcugcacuacaagguguccgacucgaccaacaucaacaucccgaacaugaacgagaccucccccaccgcgacgaucaucaacaaccacccccagaacaacuucaccaacaucaccaacaucaucgugaacaagaacgaggaggagaacuucuuuaaccuggccaagccccucugcgaggucaacucguggcacauccuguccaaggacaacgccauccgcaucggcgagaacgcccacauccuggugacccgggagccguaccucucgugcgacccccaggggugccgcauguucgcccugucccagggcacgacccugcggggccagcacgcgaacgggaccauccacgaccgcucgcccuuccgggcccucaucuccugggagaugggccaggcccccucgccguacaacgcccgcguggagugcaucgggugguccucgaccuccugccaugacggcaucucgcggauguccaucugcaucucggggcccaacaacaacgcguccgccgucgugugguacggcggccgccccgugacggagauccccucgugggccgggaacauccugcggacccaggagucggagugcgucugccacggcgggaucugcccgguggugaugaccgacggccccgccaacaaccgcgccgagaccaagaucaucuacuucaaggagggcaagauccagaagaucgaggaccugaaggggaacgcgcagcacaucgaggagugcuccugcuacggcgccucggggaugaucaaguguaucugccgggacaacuggaagggcgccaaccgccccgucaucacgaucgaccccgagaugaugacccacaccuccaaguaccucugcucgaagauccugaccgacacgucccggccgaacgaccccaccaacgggaacugcgacgcccccaucaccggcggcucgcccgacccgggggugaagggcuucgccuuccuggacggggagaacuccuggcucggccgcaccaucucgaaggacucccggucgggguacgagaugcugaaggugcccaacgcggagacggauacccaguccggcgccaucucgcaccagaugaucgucaacaaccagaacugguccggcuacucgggggccuucaucgacuacugggccaacaaggagugcuucaaccccugcuucuacguggagcugauccgcggccggcccaaggaguccucggugcucuggaccuccaacucgaucgucgcccugugcgggucccgcgagcggcugggcucguggucguggcacgacggggcggagaucaucuacuucaaguga

SEQ ID NO: 26835 - RNA, 1413 nt, Artificial Sequence
  derived and/or modified CDS sequence (AUadapt) from InfluenzaA__AHJ57911__NA
augaaucccaaccagaagaucacgugcaucucggccaccggcgugacccuguccgucgugucgcuccugaucgggaucgccaaccugggccucaacaucgggcugcacuacaagguguccgacucguccaacaucaacaucccgaacaugaacgagaccaaccccaccaccacgaucaucaacaaccacacccagaacaacuucaagaacaucaccaacaucaucgucaacaagaacgaggagggcaucuuccugaaucucaccaagccccugugcgaggugaacucguggcacauccuguccaaggacaacgcgauccgcaucggggaggacgcccacauccucgugacgcgggagcccuaccugucgugcgacccgcagggcugccgcauguucgcccugucccagggcaccacccuccgggggcgccacgccaacggcaccauccacgaccggucgcccuuccgcgcccugaucuccugggagauggggcaggcgcccucgcccuacaacgcccgggucgagugcaucggcugguccucgacguccugccaugacgggaucucgcgcauguccaucugcaucucgggcccgaacaacaacgccuccgccguggugugguaccggggccgccccgucaccgagauccccucgugggcggggaacauccugcggacccaggagucggagugcgugugccacaagggcaucugccccguggucaugaccgacgggccggccaacaaccgcgccgccacgaagaucaucuacuucaaggagggcaagauccagaagaucgaggagcucaagggcaacgcccagcacaucgaggagugcuccugcuacggggcggccggcaugaucaagugcaucugccgggauaacuggcgcggggccaaccggcccgugaucaccaucgaccccgagaugaugacccacaccucgaaguaccugugcuccaagauccugacggacaccucgcgccccaacgacccgaccaacggcaacugcgacgcccccaucaccgggggcucccccgaccccggcgugaagggguucgccuuccucgacggcgagaacucguggcuggggcggacgaucuccaaggacucgcgcuccggcuacgagaugcugaaggucccgaacgcggagaccgacacccagaguggguccaccucguaccagaucaucgugaacaaccagaacugguccggcuacucgggcgccuucaucgacuacugggccaacaaggagugcuucaaccccugcuucuacguggagcucauccgggggcgccccaaggaguccucgguccuguggacguccaacucgaucguggcccugugcggcucccgggagcgccucgggucguggucguggcacgacggcgccgagaucaucuacuucaaguga

SEQ ID NO: 26836 - RNA, 1410 nt, Artificial Sequence
  derived and/or modified CDS sequence (AUadapt) from InfluenzaA__AHJ57923__NA
augaaccccaaccagaagaucaucaccgugggcucggucucccuggccaucgccaccaucugcuuccucaugcagaucgcgauccuggccacgaccgugacccugcacuucaagcagaacgagugcaacaucccgagcaagaaccaggugaugcccugcgagcccaucaucaucgagcgcaacaucaccgaggucguguaccucaacaacacgaucaucgagaaggagaucugccccaagguggucgaguaccggaacugguccaagccgcagugccagaucaccggguucgcccccuucucgaaggacaacuccauccgccugagcgccggcggggacaucugggugacccgggagcccuacguguccugcucgcccuccaagugcuaccaguucgcccugggccaggggaccacgcucgacaacagccacuccaacggcaccauccacgaccgcaucccgcaccggacccugcugaugaacgagcucggcguccccuuccaccuggggaccaagcaggucugcaucgcguggagcuccucguccugccacgacggccgcgccuggcugcacgugugcaucacgggggacgaccggaacgccaccgccagcuucaucuacaacggcaugcucguggacuccaucucguccuggagccgcaacauccugcggacccaggagucggagugcgugugcaucaacgggaccugcacggugaucaugaccgacggcuccgcgagcggcgucgccgacacccgcauccuguucauccgggaggggaagaucgugcacgugagcccccucuccggcuccgcccagcacaucgaggagugcucgugcuacccccgcuacccggacguccggugcgugugccgcgacaacuggaagggguccaaccggcccguggucgacaucaacauggccgacuacagcaucgacucccacuacgugugcucgggccuggugggcgacacgccccgcaacgacgacuccagcuccucguccaacugcaaggaccccaacaacgagcgggggaacccgggcgucaaggggugggccuucgacgacggcaacgacguguggauggggcgcaccaucagccgggacucccgcagcggcuacgagaccuuccgggucaucggcggguggaccaccgcgaacuccaagucgcagaucaaccgccaggugaucguggacaacaacaacuggagcggcuacuccggggucuucucgguggagggcaaguccugcaucaaccgcugcuucuacguggagcugauccgggggcgcccccaggagacgcgggucugguggaccagcaacuccaucgugguguucugcggcaccagcggcaccuacgggacgggcuccuggcccgacggggccaacaucaacuucaugcccaucuga

SEQ ID NO: 26837 - RNA, 1380 nt, Artificial Sequence
  derived and/or modified CDS sequence (AUadapt) from InfluenzaA__AHJ57935__NA
augaaucccaaccagaagaucacgugcaucucggccaccggcgugacccuguccgucgugucgcuccugaucgggaucgccaaccugggccucaacaucgggcugcacuacaagguguccgacaguccgaccaucaacauccccaacaugaacgagaccaaccccaccacgaccaacaucaccaacaucaucgucaacaagaacgaggagggcaccuuccugaaucucacgaagccccugugcgaggugaacuccuggcacauccugucgaaggacaacgcgauccgcaucggggaggacgcccacauccucgugacccgggagccguaccuguccugugacccccagggcugccgcauguucgcccugucgcagggcaccacccuccgggggcgccacgccaacggcacgauccacgaccggucccccuuccgcgcccugaucaguugggagauggggcaggcgcccuccccguacaacacccgggucgagugcaucggcuggucguccaccucgugccacgacgggaucucccgcaugucgaucuguaucuccggccccaacaacaacgccucggccguggugugguaccggggccgccccgucaccgagauccccuccugggccgggaacauccugcggacgcaggagucggagugcgugugccauaagggcaucugcccgguggucaugaccgacgggcccgcgaacaacaaggccgccaccaagaucaucuacuucaaggagggcaagauccagaagaucgaggagcuccagggcaacgcccagcacaucgaggagugcaguugcuacggggccgcgggcaugaucaagugcgugugccgcgacaacuggaagggggccaaccggcccaucaucaccaucgaccccgagaugaugacgcacaccuccaaguaucugugcucgaagauccugaccgacaccucccgcccgaacgaccccacgaacggcaacugcgacgcccccaucaccgggggcagucccgacccgggcgugaagggguucgccuuccucgacggcgagaacuccuggcuggggcggaccaucucgaaggacucccgcucgggcuacgagaugcugaagguccccaaugcccagaccgacacgcaguccgggcccaccucguaccagcucaucgugaacaaccagaacugguccggcuacucgggcgcguucaucgauuacugggccaacaaggagugcuucaaccccugcuucuacguggagcugauccgggggcgcccgaaggaguccaacguccuguggaccaguaacuccaugguggcccucugcggcucgcgggagcgccugggguccuggucguggcacgacgacgccgagaucaucuacuucaaguga

SEQ ID NO: 26838 - RNA, 1410 nt, Artificial Sequence
  derived and/or modified CDS sequence (AUadapt) from InfluenzaA__AHJ57946__NA
augaaccccaaccagaagaucaucaccaucggcucggugucccugaccaucgccacggucucguuccucaugcagaucgccauccugaccaccaccgugacgcugcacuucaagcacaacgagugcaacaugccgcccaagaaccaggugauguccugcgagcccaucaucaucgagcgcaacaucaccgagaucgucuaccucaacaacaccaccguggagaaggagaucugccccaagguggucgaguaccggaacuggagcaagccgcagugcaagaucacgggguucgcgcccuucuccaaggacaacucgauccgccuguccgccggcggggacaucugggugacccgggagcccuacgugagcugcggccuggggaagugcuaccaguucgcccucggccagggcaccacccuggacaacucccacucgaacgggacgauccacgaccgcaucccccaccggacccugcucaugaacgagcugggcgucccguuccaccuggggaccaagcaggucugcaucgccugguccucguccagcugccacgacggccgcgccuggcuccacaucugcaucaccggggacgaccggaacgcgacggccuccuucaucuacgacggcaugcugguggacucgaucggcuccuggagcaagaacauccugcgcacccaggaguccgagugcgugugcaucaacgggaccugcgccguggugaugaccgacggcucggccagcggggucgcggacacgcggauccucuucauccgcgagggcaagaucgugcacaucucgccccuguccggcuccgcccagcacaucgaggagugcucgugcuacccccgguaccccgacgugcgcugcgucugccgggacaacuggaagggguccaaccgcccggugaucgacaucaacauggccgacuacagcaucgacucccacuacgugugcucgggccuggucggggacacgccccggaacgacgacaacuccagcuccucgaacugccgcgaccccaacaacgagcggggcaaccccggggugaagggcugggccuucgacgacggcaacgacguguggauggggcgcaccaucaaccgggacucccgcucgggcuacgagaccuuccgggucaucgggggcuggaccaccgccaacuccaagagccagaucaaccgccaggugaucgucgacaacaacaacugguccggguacucgggcguguucuccguggagggcaagagcugcaucaaccgcugcuucuacgucgagcucauccgggggcgcccgcaggagccccgggugugguggaccucgaacuccaucguggucuucugcggcaccagcgggacguacggcaccggguccuggcccgacggcgcgaacaucaacuucaugcccaucuga

SEQ ID NO: 26839 - RNA, 1410 nt, Artificial Sequence
  derived and/or modified CDS sequence (AUadapt) from InfluenzaA__AHJ57957__NA
augaaccccaaccagaagaucaucaccaucggcucggugucccugaccaucgccacggucucguuccucaugcagaucgccauccugaccaccaccgugacgcugcacuucaagcagaacgagugcaacaugccgcccaagaaccaggugauguccugcgagcccaucaucaucgagcgcaacaucaccgagaucgucuaccucaacaacaccaccguggagaaggagaucugccccaagguggucgaguaccggaacuggagcaagccgcagugcaagaucacgggguucgcgcccuucuccaaggacaacucgauccgccuguccgccggcggggacaucugggugacccgggagcccuacgugagcugcggccuggggaagugcuaccaguucgcccucggccagggcaccacccuggacaacucccacucgaacgggacgauccacgaccgcaucccccaccggacccugcucaugaacgagcugggcgucccguuccaccuggggaccaagcaggucugcaucgccugguccagcuccucgugccacgacggccgcgccuggcuccacaucugcaucaccggggacgaccggaacgcgacggccuccuucaucuacgacggcaugcugguggacagcaucggcuccuggucgaagaacauccugcgcacccaggaguccgagugcgugugcaucaacgggaccugcgccguggugaugaccgacggcagcgccucgggggucgcggacacgcggauccucuucauccgcgagggcaagaucgugcacaucucgccccuguccggcuccgcccagcacaucgaggagugcagcugcuacccccgguaccccgacgugcgcugcgucugccgggacaacuggaagggguccaaccgcccggugaucgacaucaacauggccgacuacucgaucgacuccaacuacgugugcagcggccuggucggggacacgccccggaacgacgacaacuccucguccagcaacugccgcgaccccaacaacgagcggggcaaccccggggugaagggcugggccuucgacuacggcaacgacguguggauggggcgcaccaucaaccgggacucccgcucgggcuacgagaccuuccgggucaucgggggcuggaccaccgccaacuccaagagccagaucaaccgccaggugaucgucgacaacaacaacugguccggguacucgggcguguucuccguggagggcaagagcugcaucaaccgcugcuucuacgucgagcucauccgggggcgcccgcaggagccccgggugugguggaccucgaacuccaucguggucuucugcggcaccagcgggacguacggcaccggguccuggcccgacggcgcgaacaucaacuucaugcccaucuga

SEQ ID NO: 26840 - RNA, 1410 nt, Artificial Sequence
  derived and/or modified CDS sequence (AUadapt) from InfluenzaA__AHJ57968__NA
augaaccccaaccagaagaucaucaccgugggcucggucucccuggccaucgccaccaucugccuccugaugcagaucgcgauccuggccacgaccgugacccuccacuucaagcagaacgagugcaacaucccgagcaagaaccaggugaugcccugcgagcccaucaucaucgagcgcaacaucaccgaggucguguaccugaacaacacgaucaucgagaaggagaucugccccaagguggucgaguaccggaacugguccaagccgcagugccagaucaccggguucgcccccuucucgaaggacaacuccauccgccugagcgccggcggggacaucugggugacccgggagcccuacguguccugcucgcccuccaagugcuaccaguucgcccucggccaggggaccacgcuggacaacagccacuccaacggcaccauccacgaccgcaucccgcaccggacccugcucaugaacgagcugggcguccccuuccaccuggggaccaagcaggucugcaucgcguggucguccagcuccugccacgacggccgcgccuggcuccacgugugcaucacgggggacgaccggaacgccaccgccucguucaucuacaacggcaugcugguggacuccaucagcuccuggucgcgcaacauccugcggacccaggagagcgagugcgugugcaucaacgggaccugcacggugaucaugaccgacggcuccgcgucgggcgucgccgacacccgcauccucuucauccgggaggggaagaucgugcacaucagcccccuguccggcuccgcccagcacaucgaggagugcucgugcuacccccgcuacccggacgugcggugcgucugccgcgacaacuggaagggguccaaccggcccgugaucgacaucaacauggccgacuacagcaucgacuccaacuacgugugcucgggccuggucggcgacacgccccgcaacgacgacaacuccagcuccucgaacugccgggaccccaacaacgagcgcgggaacccgggcgugaaggggugggccuucgacgacggcaacgacguguggauggggcggaccaucaaccgcgacucccggagcggcuacgagaccuuccgcgucaucggcggguggaccaccgcgaacuccaagucgcagaucaaccgccaggugaucgucgacaacaacaacugguccggcuacagcgggguguucucgguggagggcaaguccugcaucaaccggugcuucuacgucgagcucauccgcgggcggccccaggagacgcgcgugugguggaccagcaacuccaucguggucuucugcggcaccagcugcaccuacggcacgggguccuggcccgacggcgccaacaucaacuucaugcccaucuga

SEQ ID NO: 26841 - RNA, 1413 nt, Artificial Sequence
  derived and/or modified CDS sequence (AUadapt) from InfluenzaA__AHJ57980__NA
augaaucccaaccagaagaacacgugcaucucggccaucggcaugacccuguccguggucucgcuccugaucgggguggccgaccugggccucaacaucgggcugcacuacaagguguccgacucguccaacaucaacaucccgaacaugaacgagaccaaccccaccaccaccaucaucaacaacaacccccagaacaacuuuacgaacaucaccaacaucaucgucaacaagaacgaggaggagaaguuccugaaccucaccaagccccugugcgaggugaacucguggcacauccuguccaaggacaacgcgauccgcaucggcgaggacgcccacauccucgugacccgggagccguaccugucgugcgacccccaggggugccgcauguucgcccugucccagggcacgacccuccggggccgccacgccaacgggaccauccaugaccggucgcccuuccgcgcccugaucuccugggagaugggccaggcgcccucgccguacaacgcccgggucgagugcaucgggugguccucgaccuccugccacgacggcaucucgcgcauguccaucugcaucucggggcccaacaacaacgccuccgccguggugugguacggcggccggcccgucacggagauccccucgugggcggggaacauccugcgcacccaggagucggagugcgugugucacaagggcaucugcccgguggucaugaccgacgggcccgccaacaaccgggccgccaccaagaucaucuacuucaaggagggcaagauccagaagaucgaggagcucaagggcaacgcccagcacaucgaggagugcuccugcuacggggcggccggcaugaucaagugcaucugccgcgacaacuggaagggggccaaccggcccgugaucacgaucgaccccgagaugaugacccacaccucgaaguaccugugcuccaagauccugaccgauacgucgcgcccgaacgaccccaccuccggcaacugcgacgcccccaucaccgggggcucgcccgacccgggcgugaagggguucgccuuccucgacggcgagaacuccuggcuggggcggaccaucucgaaggacucccgcucgggcuacgagaugcugaagguccccaacgcggagacggacacccaguccgggcccaucucguaccagaccaucgugaacaaccagaauugguccggcuacucgggcgccuucaucgacuacugggccaacaaggagugcuucaaccccugcuucuacguggagcucauccgggggcgcccgaaggaguccucgguccuguggaccuccaacucgaucguggcccugugcggcucccgggagcgccucgggucguggucguggcacgacggcgccgagaucaucuacuucaaguga

SEQ ID NO: 26842 - RNA, 1410 nt, Artificial Sequence
  derived and/or modified CDS sequence (AUadapt) from InfluenzaA__AHJ57992__NA
augaaccccaaccagaagaucaucaccaucggcucggugucccugaccaucgccacggucucguuccucaugcagaucgccauccugaccaccaccgugacgcugcacuucaagcacaacgagugcaacaugccgcccaagaaccaggugauguccugcgagcccaucaucaucgagcgcaacaucaccgagaucgucuaccucaacaacaccaccguggagaaggagaucugccccaagguggucgaguaccggaacuggagcaagccgcagugcaagaucacgggguucgcgcccuucuccaaggacaacucgauccgccuguccgccggcggggacaucugggugacccgggagcccuacgugagcugcggccuggggaagugcuaccaguucgcccucggccagggcaccacccuggacaacucccacucgaacgggacgauccacgaccgcaucccccaccggacccugcucaugaacgagcugggcgucccguuccaccuggggaccaagcaggucugcaucgccugguccucguccagcugccacgacggccgcgccuggcuccacaucugcaucaccggggacgaccggaacgcgacggccuccuucaucuacgacggcaugcugguggacucgaucggcuccuggagcaagaacauccugcgcacccaggaguccgagugcgugugcaucaacgggaccugcgccguggugaugaccgacggcucggccagcggggucgcggacacgcggauccucuucauccgcgagggcaagaucgugcacaucucgccccuguccggcuccgcccagcacaucgaggagugcucgugcuacccccgguaccccgacgugcgcugcgucugccgggacaacuggaagggguccaaccgcccggugaucaacaucaacauggccgacuacagcaucgacuccaacuacgugugcucgggccuggucggggacacgccccggaacgacgacaacuccagcuccucgaacugccgcgaccccaacaacgagcggggcaaccccggggugaagggcugggccuucgacgacggcaacgacguguggauggggcgcaccaucaaccgggacucccgcucgggcuacgagaccuuccgggucaucgggggcuggaccaccgccaacuccaagagccagaucaaccgccaggugaucgucgacaacaacaacugguccggguacucgggcguguucuccguggagggcaagagcugcaucaaccgcugcuucuacgucgagcucauccgggggcgcccgcaggagccccgggugugguggaccucgaacuccaucguggucuucugcggcaccagcgggacguacggcaccggguccuggcccgacggcgcgaacaucaacuucaugcccaucuga

SEQ ID NO: 26843 - RNA, 1413 nt, Artificial Sequence
  derived and/or modified CDS sequence (AUadapt) from InfluenzaA__AHJ58004__NA
augaaucccaaccagaagaucacgugcaucucggccaccggcgugacgcuguccgucgugucgcuccugaucgggaucgccaaccugggccucaacaucgggcugcacuacaagguguccgacucguccaacaucaacaucccgaacaugaacgagaccaaccccaccaccacgaucaucaacaaccacacccagaauaacuucaagaacaucaccaacaucaucgucaacaagaacgaggagggcaccuuccugaaccucacgaagccccugugcgaggugaacucguggcacauccuguccaaggacaacgcgauccgcaucggggaggacgcccacauccucgugacccgggagcccuaccugucgugugacccgcagggcugccgcauguucgcccugucccagggcaccacccuccgggggcgccacgccaacggcacgauccacgaccggucgcccuuccgcgcccugaucuccugggagauggggcaggcgcccucgcccuacaacgcccgggucgagugcaucggcugguccucgaccuccugccacgacgggaucucgcgcauguccaucugcaucaguggcccgaacaacaacgccuccgccguggugugguaccggggccgccccgucaccgagauccccucgugggcggggaacauccugcggacccaggagucggagugcgugugccacaagggcaucugccccguggucaugacggacgggccggccaacaaccgcgccgccaccaagaucaucuacuucaaggagggcaagauccagaagaucgaggagcucaagggcaacgcccagcacaucgaggaguguuccugcuacggggcggccggcaugaucaagugcaucugccgggacaacuggcgcggggccaaccggcccgugaucaccaucgaccccgagaugaugacccacacgucgaaguaccugugcuccaagauccugaccgacaccucgcgccccaacgacccgaccaacggcaacugcgaugagcccaucaccgggggcucccccgaccccggcgugaagggguucgccuuccucgacggcgagaacucguggcuggggcggaccaucuccaaggacucgcgcuccggcuacgagaugcugaaggucccgaacgccgagaccgacacccagucggggcccacguccuaccagaucaucgugaacaaccagaacuggucgggcuacuccggcgcguuuaucgacuacugggccaacaaggagugcuucaaccccugcuucuacguggagcucauccgggggcgccccaaggagucguccguccuguggaccucgaacuccaucguggcccugugcggcucgcgggagcgccucggguccuggucguggcacgacggcgccgagaucaucuacuucaaguga

SEQ ID NO: 26844 - RNA, 1413 nt, Artificial Sequence
  derived and/or modified CDS sequence (AUadapt) from InfluenzaA__AHJ58016__NA
augaaucccaaccagaagaucacgugcaucucggccaccggcaugacccuguccguggucucgaugcucaucgggaucgccaaccugggccugaacaucgggcuccacuacaagguguccgacucgaccaacaucaacaucccgaagaugaacgagaccaaccccaccacgaccaucaucaacaaucacccccagaacaacuucaccaacaucaccaacaucaucgugaacaagaacgaggaggagaacuuccugaaccugacgaagccccucugcgaggucaacuccuggcacauccugucgaaggacaaugcgauccgcaucggcgagaacgcccacauccuggugacccgggagccguaccucuccugcgacccccaggggugccgcauguucgcccugucgcagggcaccacccugcggggccgccacgccaacgggacgauccacgaccggucccccuuccgcgcccucaucucgugggagaugggccaggcgcccuccccguacaacgcccggguggaguguaucggguggucguccaccucgugccacgacggcaucucccgcaugucgaucugcaucuccgggcccaacaacaacgccucggccgucgugugguacggcggccggcccgugaccgagauccccuccugggcggggaacauccugcgcacccaggagucggagugcgucugccauggcgggaucugcccgguggugaugacggacggccccgccaacaaccgggccgagaccaagaucaucuacuucaaggagggcaagauccagaagaucgaggagcugaaggggaacgcccagcacaucgaggagugcucgugcuacggcgccuccgggaugaucaagugcaucugccgcgacaacuggaagggcgcgaaucggcccgucaucaccaucgaccccgagaugaugacccacacgucgaaguaccucugcuccaagauccugaccgacaccucgcgcccgaacgaccccaccaacgggaacugcgacgcccccaucacgggcggcucccccgacccgggggugaagggcuucgccuuccuggaugggaagaacucguggcucggccggaccaucuccaaggacucgcgcuccggguacgagaugcugaaggugcccaacgccgagaccgacacccagucgggcgccaucucccaccagaucaucgucaacaaccagaacuggucgggcuacuccggggcguucaucgacuauugggccaacaaggagugcuucaaccccugcuucuacguggagcugauccggggccgccccaaggagucguccgugcucuggacgucgaacuccaucgucgcccugugcgggucgcgggagcgccugggcuccuggucguggcacgacggggccgagaucaucuaccucaaguga

SEQ ID NO: 26845 - RNA, 1413 nt, Artificial Sequence
  derived and/or modified CDS sequence (AUadapt) from InfluenzaA__AHJ58028__NA
augaaucccaaccagaagaucacgugcaucucggccaccggcaugacccuguccguggucucgaugcucaucgggaucgccaaccugggccugaacaucgggcuccacuacaagguguccgacucgaccaacaucaacaucccgaagaugaacgagaccaaccccaccacgaccaucaucaauaaccacccccagaacaacuucaccaacaucaccaacaucaucgugaacaagaacgaggaggagaacuuccugaaccugacgaagccccucugcgaggucaacuccuggcauauccugucgaaggacaacgcggugcgcaucggcgaggacgcccacauccuggugacccgggagccguaccucuccugcgacccccaggggugccgcauguucgcccugucgcagggcaccacccugcggggccgccacgccaacgggacgauccacgaucggucccccuuccgcgcccucaucucgugggagaugggccaggcgcccuccccguacaacacccgggucgagugcaucggguggucguccaccucgugccacgacggcaucucccgcaugucgaucugcaucuccgggcccaacaacaaugccucggccguggugugguaccggggccgccccgucaccgagauccccuccugggccggcaacauccugcggacgcaggagucggagugcgugugccacaaggggaucugcccgguggucaugaccgacggccccgcgaacaaccgcgccgagaccaagaucaucuacuucaaggaggggaagauccagaagaucgaggagcuggagggcaacgcccagcauaucgaggagugcucgugcuacggcaccgccgggaugaucaagugcaucugccgggacaacuggcgcggcgccaaccggcccgugaucacgaucgaccccgagaugaugacccacaccucccgcuaccucugcucgaagauccugaccgauacgucccggccgaacgaccccaccaacgggaacugcgacgcgcccaucaccggcgggucgcccgacccgggcgugaagggcuucgccuuccuggacgggaagaacuccuggcucggccgcaccaucucgaaggacucccggaguggguacgagaugcugaagguccccaacgccgagacggacauccaguccggccccaccucgaaccagaucaucgugaacaaccagaacugguccggguacucgggcgccuucaucgacuacugggccaacaaggaguguuucaaccccugcuucuacguggagcugauccgcggccggccgaaggaguccaacguccucuggaccucgaacuccaucguggcgcugugcgggucgcgcgagcgccugggcuccuggucguggcacgacggggccgagaucaucuacuucaaguga

SEQ ID NO: 26846 - RNA, 1410 nt, Artificial Sequence
  derived and/or modified CDS sequence (AUadapt) from InfluenzaA__AHJ58040__NA
augaaccccaaccagaagaucaucaccgugggcucggucucccuggccaucgccaccaucugccuccugaugcagaucgcgauccuggccacgaccgugacccuccacuucaagcagaacgagugcaacaucccgagcaagaaccaggugaugcccugcgagcccaucaucaucgagcgcaacaucaccgaggucguguaccugaacaacacgaucaucgagaaggagaucugccccaagguggucgaguaccggaacugguccaagccgcagugccagaucaccggguucgcccccuucucgaaggacaacuccauccgccugagcgccggcggggacaucugggugacccgggagcccuacguguccugcucgcccuccaagugcuaccaguucgcccucggccaggggaccacgcuggacaacagccacuccaacggcaccauccacgaccgcaucccgcaccggacccugcucaugaacgagcugggcguccccuuccaccuggggaccaagcaggucugcaucgcguggucguccagcuccugccacgacggccgcgccuggcuccacgugugcaucacgggggacgaccggaacgccaccgccucguucaucuacaacggcaugcugguggacuccaucagcuccuggucgcgcaacauccugcggacccaggagagcgagugcgugugcaucaacgggaccugcacggugaucaugaccgacggcuccgcgagcggcgucgccgacacccgcauccucuucauccgggaggggaagaucgugcacgugucgccccuguccggcuccgcccagcacaucgaggagugcagcugcuacccccgcuacccggacguccggugcgugugccgcgacaacuggaagggguccaaccggcccguggucgacaucaacauggccgacuacucgaucgacucccacuacgugugcagcggccuggugggcgacacgccccgcaacgacgacuccucguccagcuccaacugcaaggaccccaacaacgagcgggggaacccgggcgucaaggggugggccuucgacgacggcaacgacguguggauggggcgcaccaucucgcgggacucccgcagcggcuacgagaccuuccgggucaucggcggguggaccaccgcgaacuccaagucgcagaucaaccgccaggugaucguggacaacaacaacuggagcggcuacuccggggucuucucgguggagggcaaguccugcaucaaccgcugcuucuacguggagcucauccgggggcgcccccaggagacgcgggucugguggaccagcaacuccaucgugguguucugcggcaccagcggcaccuacgggacgggcuccuggcccgacggggccaacaucaacuucaugcccaucuga

SEQ ID NO: 26847 - RNA, 1410 nt, Artificial Sequence
  derived and/or modified CDS sequence (AUadapt) from InfluenzaA__AHJ58052__NA
augaaccccaaccagaagaucaucaccaucggcucggugucccugaccaucgccacggucucguuccucaugcagaucgccauccugaccaccaccgugacgcugcacuucaagcacaacgagugcaacaugccgcccaagaaccaggugauguccugcgagcccaucaucaucgagcgcaacaucaccgagaucgucuaccucaacaacaccaccguggagaaggagaucugccccaagguggucgaguaccggaacuggagcaagccgcagugcaagaucacgggguucgcgcccuucuccaaggacaacucgauccgccuguccgccggcggggacaucugggugacccgggagcccuacgugagcugcggccuggggaagugcuaccaguucgcccucggccagggcaccacccuggacaacucccacucgaacgggacgauccacgaccgcaucccccaccggacccugcucaugaacgagcugggcgucccguuccaccuggggaccaagcaggucugcaucgccugguccucguccagcugccacgacggccgcgccuggcuccacaucugcaucaccggggacgaccggaacgcgacggccuccuucaucuacgacggcaugcugguggacucgaucggcuccuggagcaagaacauccugcgcacccaggaguccgagugcgugugcaucaacgggaccugcgccguggugaugaccgacggcucggccagcggggucgcggacacgcggauccucuucauccgcgagggcaagaucgugcacaucucgccccuguccggcuccgcccagcacaucgaggagugcucgugcuacccccgguaccccgacgugcgcugcgucugccgggacaacuggaagggguccaaccgcccggugaucgacaucaacauggccgacuacagcaucgacuccaacuacgugugcucgggccuggucggggacacgccccggaacgacgacaacuccagcuccucgaacugccgcgaccccaacaacgagcggggcaaccccggggugaagggcugggccuucgacgacggcaacgacguguggauggggcgcaccaucaaccgggacucccgcucgggcuacgagaccuuccgggucaucgggggcuggaccaccgccaacuccaagagccagaucaaccgccaggugaucgucgacaacaacaacugguccggguacucgggcguguucuccguggagggcaagagcugcaucaaccgcugcuucuacgucgagcucauccgggggcgcccgcaggagccccgggugugguggaccucgaacuccaucguggucuucugcggcaccagcgggacguacggcaccggguccuggcccgacggcgcgaacaucaacuucaugcccaucuga

SEQ ID NO: 26848 - RNA, 1413 nt, Artificial Sequence
  derived and/or modified CDS sequence (AUadapt) from InfluenzaA__AHJ58064__NA
augaaucccaaccagaagaucacgugcaucucggccaccggcaugacccuguccguggucucgcuccugaucgggaucgccaaccugggccucaacaucgggcugcacuacaagguguccgacucgaccaacaucaacaucccgaacaugaacgagaccucccccaccacgaccaucaucaacaaccacccccagaacaacuucaccaacaucaccaacaucaucgugaacaagaacgaggaggagaacuuccugaaucucacgaagccccugugcgaggucaacucguggcacauccuguccaaggacaacgcgauccgcaucggcgagaacgcccacauccucgugacccgggagccguaccugucgugcgacccccaggggugccgcauguucgcccugucccagggcaccacccuccggggccagcacgccaacgggacgauccacgaccgcucgcccuuccgggcccugaucuccugggagaugggccaggcgcccucgccguacaacgcccgcguggagugcaucgggugguccucgaccuccugccaugacggcaucucgcggauguccaucugcaucucggggcccaacaacaacgccuccgccgucgugugguacggcggccgccccgugaccgagauccccucgugggcggggaacauccugcggacccaggagucggagugcgucugccacggcgggaucugcccgguggugaugacggacggccccgccaacaaccgcgccgagaccaagaucaucuacuucaaggagggcaagauccagaagaucgaggagcucaaggggaacgcccagcacaucgaggagugcuccugcuacggcgccucggggaugaucaagugcaucugucgggacaacuggaagggcgcgaaccgccccgucaucaccaucgaccccgagaugaugacccacacguccaaguaccugugcucgaagauccugaccgacaccucccggccgaacgaccccaucaacgggaacugcgacgcccccaucaccggcggcucgcccgacccgggggugaagggcuucgccuuccucgacggggagaacuccuggcugggccgcacgaucucgaaggacucccggucgggguacgagaugcugaaggugcccaacgccgagaccgauacccaguccggcgccaucucgcaccagaugaucgucaacaaccagaacugguccggcuacucgggggcguucaucgacuacugggccaacaaggagugcuucaaccccugcuucuacguggagcucauccgcggccggcccaaggaguccucggugcuguggaccuccaacucgaucgucgcccugugcgggucccgcgagcggcucggcucguggucguggcacgacggggccgagaucaucuacuucaaguga

SEQ ID NO: 26849 - RNA, 1401 nt, Artificial Sequence
  derived and/or modified CDS sequence (AUadapt) from InfluenzaA__AHJ58075__NA
augaaccccaaccagaagaucaucgccaucggcucggugucccugaccaucgccaucaucugcuuccuccugcagaucgcgauccugaccacgaccaugacccuccacuuccgccagaacgagugcucgaacccguccaacaaccaggucgugcccugcgagcccaucaucaucgagcggaacaccgugcaccugaacagcacgaccaucgagaaggagaucugccccaaggucgccgaguacaagaacugguccaagccgcagugccagaucaccggguucgcccccuucucgaaggacaacuccauccgccugucggccggcggggacaucugggugacccgggagcccuacguguccugcagccucggcaagugcuaccaguucgcccuggggcagggcacgacccugaagaacaagcacuccaacggcaccacccacgaccgcaucccccaccggacgcuccugaugaacgagcugggggucccguuccaccucggcaccaagcaggucugcaucgcguggucguccucguccugccacgacgggaaggccuggcugcacaucugcgugaccggcgacgacaagaacgccaccgccagcaucaucuacgacgggaugcugguggacuccaucggcucgugguccaagaacauccuccgcacgcaggagagcgagugcgugugcaucaacgggaccugcgcgguggucaugaccgacgggucggccuccggcaaggccgacacccggauccuguucauccgcgaggggaagaucaucaacaucucgccccuguccggcagcgcccagcacguggaggagugcuccugcuacccccgguaccccgaggugcgcugcgucugccgggacaacuggaagggcucgaaccgcccggugcucuacaucaacauggccgacuacuccaucgagucguccuacgugugcagcgggcuggucggcgacacgccccgggacgacgacuccucguccagcuccaacugccgcgaccccaacaacgagcggggcgcgcccggcgugaaggggugggccuucgacgacggcaacgacaucuggaugggccgcaccaucaagucggacucccggucgggguacgagaccuuccgcguggucaacggcuggaccacggccaacuccaagagccagaucaaccgccaggugaucguggacucggacuccuggucgggguacuccggcaucuucagcgucgaggggaagaacugcaucaaccggugcuucuacguggagcugauccggggccgcccgcaggagacccgcgucugguggaccuccaacucgaucaucguguucugcggcaccuccgggacguacggcaccgggagcuggcccgacggcgccaacaucaacuucaugcccaucuga

SEQ ID NO: 26850 - RNA, 1413 nt, Artificial Sequence
  derived and/or modified CDS sequence (AUadapt) from InfluenzaA__AHJ58087__NA
augaaucccaaccagaagaucacgugcaucucggccaccggcaugacccuguccguggucucgcuccugaucgggaucgccaaccugggccucaacaucgggcugcacuacaagguguccgacucgaccaacaucaacaucccgaacaugaacgagaccucccccaccacgaccaucaucaacaaccacccccagaacaacuucaccaacaucaccaacaucaucgugaacaagaacgaggaggagaacuuccugaaucucacgaagccccugugcgaggucaacucguggcacauccuguccaaggacaacgcgauccgcaucggcgagaacgcccacauccucgugacccgggagccguaccugucgugcgacccccaggggugccgcauguucgcccugucccagggcaccacccuccggggccagcacgccaacgggacgauccacgaccgcucgcccuuccgggcccugaucuccugggagaugggccaggcgcccucgccguacaacgcccgcguggagugcaucgggugguccucgaccuccugccacgauggcaucucgcggauguccaucugcaucucggggcccaacaacaacgccuccgccgucgugugguacggcggccgccccgugaccgagauccccucgugggcggggaacauccugcggacccaggagucggagugcgucugccacggcgggaucugcccgguggugaugacggacggccccgccaacaaccgcgccgagaccaagaucaucuacuucaaggagggcaagauccagaagaucgaggagcucaaggggaacgcccagcacaucgaggagugcuccugcuacggcgccucggggaugaucaagugcaucugucgggacaacuggaagggcgcgaaccgccccgucaucaccaucgaccccgagaugaugacccacacguccaaguaccugugcucgaagauccugaccgacaccucccggccgaacgaccccaucaacgggaacugcgacgcccccaucaccggcggcucgcccgacccgggggugaagggcuucgccuuccucgacggggacaacuccuggcugggccgcacgaucucgaaggacucccggucgggguacgagaugcugaaggugcccaacgccgagaccgauacccaguccggcgccaucucgcaccagaugaucgucaacaaccagaacugguccggcuacucgggggcguucaucgacuacugggccaacaaggagugcuucaaccccugcuucuacguggagcucauccgcggccggcccaaggaguccucggugcuguggaccuccaacucgaucgucgcccugugcgggucccgcgagcggcucggcucguggucguggcacgacggggccgagaucaucuacuucaaguga

SEQ ID NO: 26851 - RNA, 1410 nt, Artificial Sequence
  derived and/or modified CDS sequence (AUadapt) from InfluenzaA__AHL80721__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaagggcuucgagaugaucugggaccccaacggguggaccggcaccgacaacaacuucucgaucaagcaggacgugguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 26852 - RNA, 1410 nt, Artificial Sequence
  derived and/or modified CDS sequence (AUadapt) from InfluenzaA__AHL80732__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucucgugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuacuacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagucgaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucaucaucgacaaguga

SEQ ID NO: 26853 - RNA, 1410 nt, Artificial Sequence; identical to SEQ ID NO: 16318
  derived and/or modified CDS sequence (AUadapt) from InfluenzaA__AHL80743__NA

SEQ ID NO: 26854 - RNA, 1410 nt, Artificial Sequence
  derived and/or modified CDS sequence (AUadapt) from InfluenzaA__AHL80754__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgugugcgugaacgggagcugcuucaccgucaugaccgacggcccguccgacggccaggcgagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 26855 - RNA, 1410 nt, Artificial Sequence; identical to SEQ ID NO: 16318
  derived and/or modified CDS sequence (AUadapt) from InfluenzaA__AHL80765__NA

SEQ ID NO: 26856 - RNA, 1410 nt, Artificial Sequence; identical to SEQ ID NO: 16318
  derived and/or modified CDS sequence (AUadapt) from InfluenzaA__AHL80776__NA

SEQ ID NO: 26857 - RNA, 1410 nt, Artificial Sequence; identical to SEQ ID NO: 16318
  derived and/or modified CDS sequence (AUadapt) from InfluenzaA__AHL80787__NA

SEQ ID NO: 26858 - RNA, 1410 nt, Artificial Sequence
  derived and/or modified CDS sequence (AUadapt) from InfluenzaA__AHL80798__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaagggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucggugaagcaggacaucguggggaucaacgagugguccggcuacagcggguccuucguccagcacccggagcugaccggccuggacugcauccgccccugcuucuggguggagcucauccggggccgccccaaggagaacacgaucuggaccagcggguccagcaucuccuucugcggcgucaacagcgacaccguggggugguccuggcccgacggcgccgagcugccguucaccaucgacaaguga

SEQ ID NO: 26859 - RNA, 1410 nt, Artificial Sequence; identical to SEQ ID NO: 16318
  derived and/or modified CDS sequence (AUadapt) from InfluenzaA__AHL80809__NA

SEQ ID NO: 26860 - RNA, 1410 nt, Artificial Sequence; identical to SEQ ID NO: 16318
  derived and/or modified CDS sequence (AUadapt) from InfluenzaA__AHL80820__NA

SEQ ID NO: 26861 - RNA, 1410 nt, Artificial Sequence; identical to SEQ ID NO: 16318
  derived and/or modified CDS sequence (AUadapt) from InfluenzaA__AHL80831__NA

SEQ ID NO: 26862 - RNA, 1410 nt, Artificial Sequence; identical to SEQ ID NO: 16318
  derived and/or modified CDS sequence (AUadapt) from InfluenzaA__AHL80842__NA

SEQ ID NO: 26863 - RNA, 1410 nt, Artificial Sequence; identical to SEQ ID NO: 20428
  derived and/or modified CDS sequence (AUadapt) from InfluenzaA__AHL80853__NA

SEQ ID NO: 26864 - RNA, 1410 nt, Artificial Sequence
  derived and/or modified CDS sequence (AUadapt) from InfluenzaA__AHL80864__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuacuacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaagggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 26865 - RNA, 1410 nt, Artificial Sequence; identical to SEQ ID NO: 20428
  derived and/or modified CDS sequence (AUadapt) from InfluenzaA__AHL80875__NA

SEQ ID NO: 26866 - RNA, 1410 nt, Artificial Sequence; identical to SEQ ID NO: 20428
  derived and/or modified CDS sequence (AUadapt) from InfluenzaA__AHL80886__NA

SEQ ID NO: 26867 - RNA, 1410 nt, Artificial Sequence
  derived and/or modified CDS sequence (AUadapt) from InfluenzaA__AHL80897__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcaucaacgggucgugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaagggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugaccggccuggacugcauccgccccugcuucuggguggagcucauccggggccgccccaaggagaacacgaucuggaccagcggguccagcaucuccuucugcggcgucaacagcgacaccguggggugguccuggcccgacggcgccgagcugccguucaccaucgacaaguga

SEQ ID NO: 26868 - RNA, 1410 nt, Artificial Sequence
  derived and/or modified CDS sequence (AUadapt) from InfluenzaA__AHL80908__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaccauccacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuacuacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaagggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 26869 - RNA, 1410 nt, Artificial Sequence
  derived and/or modified CDS sequence (AUadapt) from InfluenzaA__AHL80919__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcucgccccuggagugccgcaccuucuuccugacccagggcgcccuccugaacgacaagcacuccaacgggaccaucaaggaccggagccccuaccgcacgcugauguccugcccgaccggcgagguccccagccccuacaacagccgguucgaguccguggccuggucggcguccgccugccacgacgggaucaacuggcucaccaucggcaucagcggccccgacaacggggccguggccguccugaaguacaacggcaucaucaccgacacgaucaaguccuggcgcaacaacauccugcggacccaggagagcgagugcgcgugcgugaacggguccugcuucaccaucaugaccgacggcccgagcgacggccaggccuccuacaagaucuuccgcaucgagaaggggaagaucgucaagucgguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucucguccaacggggccaacggcgugaagggguucagcuucaaguacggcaacgggguguggaucggccgcaccaagagcaucuccagccggaagggcuucgagaugaucugggaccccaacggguggaccggcacggacaacaacuucuccaucaagcaggacaucgucgggaucaacgaguggucgggcuacuccgggagcuucgugcagcacccggagcugaccggccuggacugcauccgccccugcuucuggguggagcucauccggggccgccccaaggagaacaccaucuggaccuccgggagcuccaucagcuucugcggcgucaacuccgacacggugggguggagcuggcccgacggcgccgagcugccguucaccaucgacaaguga

SEQ ID NO: 26870 - RNA, 1410 nt, Artificial Sequence; identical to SEQ ID NO: 21920
  derived and/or modified CDS sequence (AUadapt) from InfluenzaA__AHL80930__NA

SEQ ID NO: 26871 - RNA, 1410 nt, Artificial Sequence; identical to SEQ ID NO: 21920
  derived and/or modified CDS sequence (AUadapt) from InfluenzaA__AHL80949__NA

SEQ ID NO: 26872 - RNA, 1410 nt, Artificial Sequence
  derived and/or modified CDS sequence (AUadapt) from InfluenzaA__AHL80961__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucucgaucaagcaggacgucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 26873 - RNA, 1410 nt, Artificial Sequence; identical to SEQ ID NO: 26872
  derived and/or modified CDS sequence (AUadapt) from InfluenzaA__AHL80972__NA

SEQ ID NO: 26874 - RNA, 1410 nt, Artificial Sequence; identical to SEQ ID NO: 21920
  derived and/or modified CDS sequence (AUadapt) from InfluenzaA__AHL80983__NA

SEQ ID NO: 26875 - RNA, 1410 nt, Artificial Sequence; identical to SEQ ID NO: 21920
  derived and/or modified CDS sequence (AUadapt) from InfluenzaA__AHL80992__NA

SEQ ID NO: 26876 - RNA, 1410 nt, Artificial Sequence; identical to SEQ ID NO: 21920
  derived and/or modified CDS sequence (AUadapt) from InfluenzaA__AHL81004__NA

SEQ ID NO: 26877 - RNA, 1410 nt, Artificial Sequence
  derived and/or modified CDS sequence (AUadapt) from InfluenzaA__AHL81016__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgacuccgacaagugcuaccaguucgcccucggccaggggaccacgcugaacaacgugcacagcaacaacaccguccgcgaccggacccccuaccgcacccugcucaugaacgagcugggcgugccguuccaccugggcacgaagcaggucugcaucgccugguccucguccagcugccacgacgggaaggccuggcuccacgugugcaucaccggcgacgacaagaacgcgaccgccuccuucaucuacaacgggcggcugguggacucgguggucuccuggagcaaggagauccugcgcacccaggaguccgagugcgugugcaucaacggcacgugcaccguggucaugaccgacgggucggccagcggcaaggccgacaccaagauccucuucaucgaggagggcaagaucgugcacacguccacccugucgggguccgcgcagcacguggaggagugcagcugcuacccccgguaccccggcguccgcugcgugugccgggacaacuggaagggguccaaccgccccaucguggacaucaacaucaaggaccacucgaucgucuccagcuacgugugcuccggccuggugggcgacaccccgcggaagaacgacucguccagcuccucgcacugccucgaccccaacaacgaggagggcgggcacggggucaagggcugggccuucgacgacgggaacgacguguggaugggccgcaccaucaacgagacgucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcacguccgggaccuacggcaccgggagcuggcccgacggcgccgaccugaaccucaugccgaucuga

SEQ ID NO: 26878 - RNA, 1410 nt, Artificial Sequence; identical to SEQ ID NO: 21920
  derived and/or modified CDS sequence (AUadapt) from InfluenzaA__AHL81028__NA

SEQ ID NO: 26879 - RNA, 1410 nt, Artificial Sequence; identical to SEQ ID NO: 21920
  derived and/or modified CDS sequence (AUadapt) from InfluenzaA__AHL81040__NA

SEQ ID NO: 26880 - RNA, 1410 nt, Artificial Sequence; identical to SEQ ID NO: 21920
  derived and/or modified CDS sequence (AUadapt) from InfluenzaA__AHL81052__NA

SEQ ID NO: 26881 - RNA, 1410 nt, Artificial Sequence; identical to SEQ ID NO: 26872
  derived and/or modified CDS sequence (AUadapt) from InfluenzaA__AHL81064__NA

SEQ ID NO: 26882 - RNA, 1410 nt, Artificial Sequence; identical to SEQ ID NO: 26872
  derived and/or modified CDS sequence (AUadapt) from InfluenzaA__AHL81075__NA

SEQ ID NO: 26883 - RNA, 1410 nt, Artificial Sequence
  derived and/or modified CDS sequence (AUadapt) from InfluenzaA__AHL81086__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcaagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggaccggggcaaccgcuccggguacucgggcaucuucuccgucgagggcaagagcugcaucaaccggugcuucuacguggagcucauccgcgggcggaaggaggagaccgaggugcuguggaccucgaacuccaucgucguguucugcggcacgagcgggaccuacggcaccggguccuggccggacggcgccgaccugaaccucaugcccaucuga

SEQ ID NO: 26884 - RNA, 1410 nt, Artificial Sequence
  derived and/or modified CDS sequence (AUadapt) from InfluenzaA__AHL81098__NA
augaaccccaaccagaagaucaucaccaucggcucggugucccugaccaucagcacgaucugcuucuucguccagaucgccauccucaucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccgucgugucgugguccaaggagauccugcgcacccaggagagcgagugcgugugcaucaacggcacgugcaccgucgugaugaccgacggguccgccucgggcaaggccgacaccaagauccucuucaucgaggagggcaagaucgugcacacgagcacccuguccgggucggcgcagcacgucgaggagugcuccugcuacccccgguaccccggcgugcgcugcgugugccgggacaacuggaaggggagcaaccgcccgaucgucgacaucaacaucaaggaccacuccaucgugucguccuacgugugcagcggccuggucggcgacacgccccggaagaacgacuccucguccagcucccacugccucgaccccaacaacgaggagggcgggcacggggugaagggcugggccuucgacgacgggaacgacgucuggaugggccgcaccaucaacgagaccucgcggcugggcuacgagaccuucaaggugaucgaggggugguccaaccccaagagcaagcugcagaucaaccgccaggugaucgucgaccggggcaaccgcuccggguacucgggcaucuucuccguggagggcaagagcugcaucaaccggugcuucuacguggagcucauccgcgggcggaaggaggagaccgagguccuguggaccucgaacuccaucgugguguucugcggcacgagcgggaccuacggcaccggguccuggccggacggcgccgaccugaaccucaugcccaucuga

SEQ ID NO: 26885 - RNA, 1410 nt, Artificial Sequence; identical to SEQ ID NO: 23111
  derived and/or modified CDS sequence (AUadapt) from InfluenzaA__AHL81110__NA

SEQ ID NO: 26886 - RNA, 1410 nt, Artificial Sequence; identical to SEQ ID NO: 23111
  derived and/or modified CDS sequence (AUadapt) from InfluenzaA__AHL81121__NA

SEQ ID NO: 26887 - RNA, 1410 nt, Artificial Sequence; identical to SEQ ID NO: 21920
  derived and/or modified CDS sequence (AUadapt) from InfluenzaA__AHL81132__NA

SEQ ID NO: 26888 - RNA, 1410 nt, Artificial Sequence; identical to SEQ ID NO: 21920
  derived and/or modified CDS sequence (AUadapt) from InfluenzaA__AHL81144__NA

SEQ ID NO: 26889 - RNA, 1410 nt, Artificial Sequence; identical to SEQ ID NO: 21920
  derived and/or modified CDS sequence (AUadapt) from InfluenzaA__AHL81156__NA

SEQ ID NO: 26890 - RNA, 1410 nt, Artificial Sequence; identical to SEQ ID NO: 24189
  derived and/or modified CDS sequence (AUadapt) from InfluenzaA__AHL81168__NA

SEQ ID NO: 26891 - RNA, 1410 nt, Artificial Sequence; identical to SEQ ID NO: 24189
  derived and/or modified CDS sequence (AUadapt) from InfluenzaA__AHL81180__NA

SEQ ID NO: 26892 - RNA, 1410 nt, Artificial Sequence; identical to SEQ ID NO: 21920
  derived and/or modified CDS sequence (AUadapt) from InfluenzaA__AHL81192__NA

SEQ ID NO: 26893 - RNA, 1410 nt, Artificial Sequence
  derived and/or modified CDS sequence (AUadapt) from InfluenzaA__AHL81215__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucauguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgucucgugcgaccccgacaagugcuaccaguucgcccucggccaggggaccacgcugaacaacgugcacuccaacaacaccgugcgcgaccggaccccguaccgcacccugcucaugaacgagcugggcguccccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggucgaaccgcccgaucguggacaucaacaucaaggaccacuccaucgugagcuccuacgucugcucgggccuggugggcgacacgccccggaagaacgacuccagcuccucgucccacugccucgaccccaacaacgaggagggcgggcacggggugaagggcugggccuucgacgacgggaacgacgucuggaugggccgcaccaucaacgagaccagccggcugggcuacgagaccuucaaggugaucgaggggugguccaaccccaagucgaagcugcagaucaaccgccaggucaucguggaccggggcaaccgcuccggguacagcggcaucuucuccguggagggcaagucgugcaucaaccggugcuucuacgucgagcucauccgcgggcggaaggaggagaccgaggugcuguggaccagcaacuccaucguggucuucugcggcacgagcgggaccuacggcaccggguccuggccggacggcgccgaccugaacuucaugcccaucuga

SEQ ID NO: 26894 - RNA, 1410 nt, Artificial Sequence
  derived and/or modified CDS sequence (AUadapt) from InfluenzaA__AHL81227__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcucgccccuggagugccgcaccuucuuccugacccagggcgcccuccugaacgacaagcacuccaacgggaccaucaaggaccggagccccuaccgcacgcugauguccugcccgaccggcgagguccccagccccuacaacagccgguucgaguccguggccuggucggcguccgccugccacgacgggaucaacuggcucaccaucggcaucagcggccccgacaacggggccguggccguccugaaguacaacggcaucaucaccgacacgaucaaguccuggcgcaacaacauccugcggacccaggagagcgagugcgcgugcgugaacggguccugcuucaccaucaugaccgacggcccgagcgacggccaggccuccuacaagaucuuccgcaucgagaaggggaagaucgucaagucgguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucucguccaacggggccaacggcgugaagggguucagcuucaaguacggcaacgggguguggaucggccgcaccaagagcaucuccagccggaagggcuucgagaugaucugggaccccaacggguggaccggcacggacaacaacuucuccaucaagcaggacaucaucgggaucaacgaguggucgggcuacuccgggagcuucguccagcacccggagcugaccggccuggacugcauccgccccugcuucuggguggagcucauccggggccgccccaaggagaacaccaucuggaccuccgggagcuccaucagcuucugcggcgugaacuccgacacggucggguggagcuggcccgacggcgccgagcugccguucaccaucgacaaguga

SEQ ID NO: 26895 - RNA, 1410 nt, Artificial Sequence; identical to SEQ ID NO: 21920
  derived and/or modified CDS sequence (AUadapt) from InfluenzaA__AHL81238__NA

SEQ ID NO: 26896 - RNA, 1410 nt, Artificial Sequence; identical to SEQ ID NO: 21920
  derived and/or modified CDS sequence (AUadapt) from InfluenzaA__AHL81250__NA

SEQ ID NO: 26897 - RNA, 1410 nt, Artificial Sequence; identical to SEQ ID NO: 21920
  derived and/or modified CDS sequence (AUadapt) from InfluenzaA__AHL81262__NA

SEQ ID NO: 26898 - RNA, 1410 nt, Artificial Sequence; identical to SEQ ID NO: 21920
  derived and/or modified CDS sequence (AUadapt) from InfluenzaA__AHL81274__NA

SEQ ID NO: 26899 - RNA, 1410 nt, Artificial Sequence; identical to SEQ ID NO: 21920
  derived and/or modified CDS sequence (AUadapt) from InfluenzaA__AHL81286__NA

SEQ ID NO: 26900 - RNA, 1410 nt, Artificial Sequence; identical to SEQ ID NO: 21920
  derived and/or modified CDS sequence (AUadapt) from InfluenzaA__AHL81298__NA

SEQ ID NO: 26901 - RNA, 1410 nt, Artificial Sequence; identical to SEQ ID NO: 26872
  derived and/or modified CDS sequence (AUadapt) from InfluenzaA__AHL81310__NA

SEQ ID NO: 26902 - RNA, 1410 nt, Artificial Sequence; identical to SEQ ID NO: 23111
  derived and/or modified CDS sequence (AUadapt) from InfluenzaA__AHL81332__NA

SEQ ID NO: 26903 - RNA, 1410 nt, Artificial Sequence
  derived and/or modified CDS sequence (AUadapt) from InfluenzaA__AHL81343__NA
augaaccccaaccagaagaucaucaccaucggcucggugucccugaccaucucgacgaucugcuuccucaugcagaucgccauccugaucaccaccgucacccugcacuucaagcaguacgaguucaacuccccgcccaacaaccaggugaugcucugcgagcccacgaucaucgagcgcaacaucaccgagaucguguaccugaccaacaccacgaucgagaaggagaucugccccaagcuggccgaguaccggaacuggagcaagccgcagugcgacaucaccggguucgcgcccuucuccaaggacaacucgauccgccucuccgccggcggggacaucugggucacccgggagcccuacgugagcugcgaccccgacaagugcuaccaguucgcccugggccaggggaccacgcugaacaacgugcacuccaacaacaccguccgcgaccggaccccguaccgcacccuccugaugaacgagcugggcgugcccuuccaccucggcacgaagcaggucugcaucgccuggucguccagcuccugccacgacgggaaggccuggcugcacgugugcaucaccggcgacgacaagaacgcgaccgccucguucaucuacaacgggcggcugguggacuccguggucagcugguccaaggagauccuccgcacccaggagucggagugcgugugcaucaacggcacgugcaccguggucaucaccgacggguccgccagcggcaaggccgacaccaagauccuguucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccucgugggcgacacgccccggaagaacgacuccagcuccucgucccacugcagcgaccccaacaacgaggagggcgggcacggggucaagggcugggccuucgacgacgggaacgacguguggaugggccgcaccaucuccgagaagucccggcugggcuacgagaccuucaaggucaucgagggguggucgaaccccaagagcaagcugcagaucaaccgccaggugaucguggaccggggcaaccgcuccggguacucgggcaucuucagcgucgaggggaaguccugcaucaaccggugcuucuacguggagcucauccgcggccggaaggaggagaccgaggugcuguggaccucgaacuccaucgucguguucugcggcaccagcgggacguacggcaccggguccuggccggacggcgccgacaucaaccugaugcccaucuga

SEQ ID NO: 26904 - RNA, 1410 nt, Artificial Sequence; identical to SEQ ID NO: 21920
  derived and/or modified CDS sequence (AUadapt) from InfluenzaA__AHL81355__NA

SEQ ID NO: 26905 - RNA, 1410 nt, Artificial Sequence; identical to SEQ ID NO: 23111
  derived and/or modified CDS sequence (AUadapt) from InfluenzaA__AHL81367__NA

SEQ ID NO: 26906 - RNA, 1410 nt, Artificial Sequence; identical to SEQ ID NO: 23111
  derived and/or modified CDS sequence (AUadapt) from InfluenzaA__AHL81378__NA

SEQ ID NO: 26907 - RNA, 1410 nt, Artificial Sequence; identical to SEQ ID NO: 23111
  derived and/or modified CDS sequence (AUadapt) from InfluenzaA__AHL81389__NA

SEQ ID NO: 26908 - RNA, 1410 nt, Artificial Sequence; identical to SEQ ID NO: 21920
  derived and/or modified CDS sequence (AUadapt) from InfluenzaA__AHL81400__NA

SEQ ID NO: 26909 - RNA, 1410 nt, Artificial Sequence; identical to SEQ ID NO: 26893
  derived and/or modified CDS sequence (AUadapt) from InfluenzaA__AHL81412__NA

SEQ ID NO: 26910 - RNA, 1410 nt, Artificial Sequence; identical to SEQ ID NO: 16318
  derived and/or modified CDS sequence (AUadapt) from InfluenzaA__AHL81422__NA

SEQ ID NO: 26911 - RNA, 1410 nt, Artificial Sequence; identical to SEQ ID NO: 20428
  derived and/or modified CDS sequence (AUadapt) from InfluenzaA__AHL81433__NA

SEQ ID NO: 26912 - RNA, 1410 nt, Artificial Sequence
  derived and/or modified CDS sequence (AUadapt) from InfluenzaA__AHL88954__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucaaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccgggacaaccggucgggcuacuccgggaucuucagcgucgagggcaagucgugcaucaaccgcugcuucuacguggagcucauccgggggcgcaaggaggagaccgaggugcuguggaccuccaacagcaucgucguguucugcggcaccuccggcacguacgggaccggcagcuggccggacggggccgacaucaaccugaugcccaucuga

SEQ ID NO: 26913 - RNA, 1410 nt, Artificial Sequence
  derived and/or modified CDS sequence (AUadapt) from InfluenzaA__AHL89033__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgaggacaagucgugcaucaaccgcugcuucuacguggagcucauccgggggcgcaaggaggagaccgaggugcuguggaccuccaacagcaucgucguguucugcggcaccuccggcacguacgggaccggcagcuggccggacggggccgacaucaaccugaugcccaucuga

SEQ ID NO: 26914 - RNA, 1410 nt, Artificial Sequence
  derived and/or modified CDS sequence (AUadapt) from InfluenzaA__AHL89045__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggucguccagcuccugccacgacgggaaggccuggcuccacgugugcgugaccggcgacgacaagaacgcgaccgccucguucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgccaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccucgucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggucgaaccccaacuccaagcugcagaccaaccgccaggugaucguggaccggggcaaccggagcggguacuccggcaucuucucggucgagggcaagagcugcaucaaccgcugcuucuacguggagcucauccgggggcgcaaggaggagaccgaggugcuguggaccuccaacucgaucgucguguucugcggcacguccgggaccuacggcaccgggagcuggccggacggcgccgacaucaaccugaugcccaucuga

SEQ ID NO: 26915 - RNA, 1410 nt, Artificial Sequence
  derived and/or modified CDS sequence (AUadapt) from InfluenzaA__AHL89057__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaagcccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 26916 - RNA, 1410 nt, Artificial Sequence; identical to SEQ ID NO: 18109
  derived and/or modified CDS sequence (AUadapt) from InfluenzaA__AHL89069__NA

SEQ ID NO: 26917 - RNA, 1410 nt, Artificial Sequence; identical to SEQ ID NO: 17114
  derived and/or modified CDS sequence (AUadapt) from InfluenzaA__AHL89081__NA

SEQ ID NO: 26918 - RNA, 1410 nt, Artificial Sequence; identical to SEQ ID NO: 17114
  derived and/or modified CDS sequence (AUadapt) from InfluenzaA__AHL89093__NA

SEQ ID NO: 26919 - RNA, 1410 nt, Artificial Sequence; identical to SEQ ID NO: 17114
  derived and/or modified CDS sequence (AUadapt) from InfluenzaA__AHL89117__NA

SEQ ID NO: 26920 - RNA, 1410 nt, Artificial Sequence; identical to SEQ ID NO: 17114
  derived and/or modified CDS sequence (AUadapt) from InfluenzaA__AHL89129__NA

SEQ ID NO: 26921 - RNA, 1410 nt, Artificial Sequence
  derived and/or modified CDS sequence (AUadapt) from InfluenzaA__AHL89141__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccucgucccacugccucgaccccaacaacgaggagggcgggcacggggucaagggcugggccuucgacgacgggaacgacguguggaugggccggaccaucagcgagaagcugcgccugggcuacgagaccuucaaggucaucgaggggugguccaaccccaacucgaagcuccagaccaaccgccaggugaucguggaccggggcaaccgguccggguacagcggcaucuucuccgucgagggcaagucgugcaucaaccgcugcuucuacguggagcugauccgggggcgcaaggaggagaccgaggugcuguggaccagcaacuccaucgucguguucugcggcacgagcgggaccuacggcaccggguccuggccggacggcgccgacaucaaccucaugcccaucuga

SEQ ID NO: 26922 - RNA, 1410 nt, Artificial Sequence
  derived and/or modified CDS sequence (AUadapt) from InfluenzaA__AHL89153__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugagcugcgaccccgacaagugcuaccaguucucccucggccaggggaccacgcugaacaacgugcacucgaacgacaccguccacgaccgcaccccguaccggacccugcucaugaacgagcugggcgugcccuuccaccugggcacgaagcaggucugcaucgccugguccagcuccucgugccacgacgggaaggccuggcuccacgugugcgugaccggcgacgacaagaacgccaccgcguccuucaucuacaacgggcgccugguggacagcaucgucuccuggagcaaggagauccugcggacccaggaguccgagugcgugugcaucaacggcacgugcaccguggucaugaccgacgggucggccagcggcaaggccgacaccaagauccucuucaucgaggagggcaagaucgugcacacguccacccugucgggguccgcccagcacguggaggagugcagcugcuacccccgcuaccccggcguccggugcgugugccgcgacaacuggaagggguccaaccggccgaucguggacaucaacaucaaggacuacagcaucgucuccucguacgugugcuccggccuggugggcgacacgccccgcaagaacgacagcuccucguccagccacugccucgaccccaacaacgaggagggcgggcacggggucaagggcugggcguucgacgacgggaacgacguguggaugggccggaccaucuccgagaagcugcgcagcggcuacgagaccuucaaggucaucgaggggugguccaaccccaacucgaagcugcagaucaaccgccaggugaucguggaccggggcaaccgguccggguacagcggcaucuucucggucgaggggaaguccugcaucaaccgcugcuucuacguggagcucauccggggccgcaaggaggagaccgaggugcuguggaccagcaacuccaucgucguguucugcggcaccagcgggacguacggcaccggguccuggccggacggcgccgacaucaaccugaugcccaucuga

SEQ ID NO: 26923 - RNA, 1410 nt, Artificial Sequence; identical to SEQ ID NO: 17114
  derived and/or modified CDS sequence (AUadapt) from InfluenzaA__AHL89165__NA

SEQ ID NO: 26924 - RNA, 1410 nt, Artificial Sequence
  derived and/or modified CDS sequence (AUadapt) from InfluenzaA__AHL89177__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaacgagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaacgaggugcuguggaccuccaacagcaucgucguguucugcggcaccuccgggaccuacggcacggggagcuggccggacggcgccgacaucaaccugaugcccaucuga

SEQ ID NO: 26925 - RNA, 1410 nt, Artificial Sequence; identical to SEQ ID NO: 18966
  derived and/or modified CDS sequence (AUadapt) from InfluenzaA__AHL89189__NA

SEQ ID NO: 26926 - RNA, 1410 nt, Artificial Sequence; identical to SEQ ID NO: 18109
  derived and/or modified CDS sequence (AUadapt) from InfluenzaA__AHL89201__NA

SEQ ID NO: 26927 - RNA, 1410 nt, Artificial Sequence; identical to SEQ ID NO: 18966
  derived and/or modified CDS sequence (AUadapt) from InfluenzaA__AHL89213__NA

SEQ ID NO: 26928 - RNA, 1410 nt, Artificial Sequence
  derived and/or modified CDS sequence (AUadapt) from InfluenzaA__AHL89225__NA
augaaccccaaccagaagaucaucaccaucggcucggugucccugaccaucagcacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccccagugcaacaucaccggguucgcgcccuucucgaaggacaacuccauccgccugagcgccggcggggacaucugggucacccgggagcccuacguguccugcgacccggacaagugcuaccaguucgcccucggccaggggaccacgcugaacaacgugcacucgaacgacaccguccacgaccgcacccccuaccggacccugcucaugaacgagcugggcgugcccuuccaccugggcacgaagcaggucugcaucgccugguccagcuccucgugccacgacgggaaggccuggcuccacgugugcgugaccggcgacgacaagaacgcgaccgccuccuucaucuacaacgggcgccugguggacagcaucgucuccuggucgaaggagauccugcggacccaggaguccgagugcgugugcaucaacggcacgugcaccguggucaugaccgacgggagcgccuccggcaaggccgacaccaagauccucuucaucgaggagggcaagaucgugcacacgucgacccugagcggguccgcgcagcacguggaggagugcucgugcuacccccgcuacccgggcguccggugcgugugccgcgacaacuggaagggguccaaccggcccaucguggacaucaacaucaaggacuacagcaucgucuccucguacgugugcuccggccuggugggcgacacgccccgcaagaacgacagcuccucguccagccacugccucgaccccaacaacgaggagggcgggcacggggucaagggcugggccuucgacgacgggaacgacguguggaugggccggaccaucuccgagaagcugcgccugggcuacgagaccuucaaggucaucgagggguggucgaacccgaacuccaagcuccagaccaaccgccaggugaucguggaccggggcaaccggagcggguacuccggcaucuucucggucgaggggaaguccugcaucaaccgcugcuucuacguggagcugauccggggccgcaaggaggagaccgaggugcuguggaccagcaacucgaucgucguguucugcggcacguccgggaccuacggcaccgggagcuggcccgacggcgccgacaucaaccucaugcccaucuga

SEQ ID NO: 26929 - RNA, 1410 nt, Artificial Sequence; identical to SEQ ID NO: 18966
  derived and/or modified CDS sequence (AUadapt) from InfluenzaA__AHL89237__NA

SEQ ID NO: 26930 - RNA, 1410 nt, Artificial Sequence; identical to SEQ ID NO: 18109
  derived and/or modified CDS sequence (AUadapt) from InfluenzaA__AHL89261__NA

SEQ ID NO: 26931 - RNA, 1410 nt, Artificial Sequence
  derived and/or modified CDS sequence (AUadapt) from InfluenzaA__AHL89273__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccucgucccacugccucgaccccaacaacgaggagggcgggcacggggucaagggcugggccuucgacgacgggaacgacguguggaugggccggaccaucagcgagaagcugcgccugggcuacgagaccuucaaggucaucgaggggugguccaaccccaacucgaagcuccagaccaaccgccaggugaucguggaccggggcaaccgguccggguacagcggcaucuucuccgucgagggcaagucgugcaucaaccgcugcuucuacguggagcugauccgggggcgcaaggaggagaccgacgugcuguggaccagcaacuccaucgucguguucugcggcacgagcgggaccuacggcaccggguccuggccggacggcgccgacaucaaccucaugcccaucuga

SEQ ID NO: 26932 - RNA, 1410 nt, Artificial Sequence
  derived and/or modified CDS sequence (AUadapt) from InfluenzaA__AHL89285__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgccugggcuacgagaccuucaaggucaucgaggggugguccaaccccaacagcaagcuccagaccaaccgccaggugaucguggaccggggcaaccgguccggguacucgggcaucuucuccgucgagggcaagagcugcaucaaccgcugcuucuacguggagcugauccgggggcgcaaggaggagaccgacgugcuguggaccucgaacuccaucgucguguucugcagcacguccggcaccuacgggaccggcagcuggccggacggggccgacaucaaccucaugcccaucuga

SEQ ID NO: 26933 - RNA, 1410 nt, Artificial Sequence; identical to SEQ ID NO: 26931
  derived and/or modified CDS sequence (AUadapt) from InfluenzaA__AHL89297__NA

SEQ ID NO: 26934 - RNA, 1410 nt, Artificial Sequence; identical to SEQ ID NO: 26931
  derived and/or modified CDS sequence (AUadapt) from InfluenzaA__AHL89309__NA

SEQ ID NO: 26935 - RNA, 1410 nt, Artificial Sequence
  derived and/or modified CDS sequence (AUadapt) from InfluenzaA__AHL89321__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggucguccagcuccugccacgacgggaaggccuggcuccacgugugcgugaccggcgacgacaagaacgcgaccgccagcuucaucuacaacgggcgccugguggacuccgucgugucgugguccaaggacauccugcggacccaggagagcgagugcgugugcaucaacggcacgugcaccgucgugaugaccgacggguccgccucgggcaaggccgacaccaagauccucuucaucgaggagggcaagaucgugcacaucagcacgcuguccgggagcgcgcagcacgucgaggagugcuccugcuacccccgcuaccccggcgugcggugcgugugccgcgacaacuggaaggggucgaaccggccgaucgucgacaucaacaucaagaacuacuccaucgugagcuccuacgugugcagcggccuggucggcgacacgccccgcaagaccgacuccucguccagcucccacugccucgaccccaacaacgaggagggcgggcacggggugaagggcugggccuucgacgacgggaacgacgucuggaugggccggaccaucucggagaagcugcgccugggcuacgagaccuucaaggugaucgaggggugguccaaccccaacagcaagcuccagaucaaccgccaggugaucgucgaccggggcaaccgguccggguacagcggcaucuucuccguggagggcaagucgugcaucaaccgcugcuucuacguggagcugauccgggggcgcaaggaggagaccgagguccuguggaccagcaacuccaucgugguguucugcggcaccagcgggacguacggcaccggguccuggccggacggcgccgacaucaaccucaugcccaucuga

SEQ ID NO: 26936 - RNA, 1410 nt, Artificial Sequence
  derived and/or modified CDS sequence (AUadapt) from InfluenzaA__AHL89333__NA
augaaccccaaccagaagaucaucaccaucggcucggugucccugaccaucagcacgaucugcuucuucaugcagaucgccauccucaucgccaccgucacccugcacuucaagcaguacgaguucaacuccccgcccaacaaccaggugaugcugugcgagcccaccaucaucgagcgcaacaucacggagaucguguaccucaccaacaccaccaucgagaaggagaucugccccaagcuggcggaguaccggaacuggucgaagccgcagugcaacaucacgggguucgcccccuucuccaaggacaacagcauccgccuguccgccggcggggacaucugggucacccgggagcccuacgugucgugcgaccccgacaagugcuaccaguucgcccucggccaggggaccacccugaacaacgugcacuccaacgacacgguccacgaccgcaccccguaccggacccugcucaugaacgagcugggcgugcccuuccaccugggcaccaagcaggucugcaucgccuggagcuccucguccugccacgacgggaaggcguggcuccacgugugcgugacgggcgacgacaagaacgccaccgccagcuucaucuacaacgggcgccugguggacuccaucgucucgugguccaaggagauccugcggacccaggagagcgagugcgugugcaucaacgggaccugcgccguggucaugacggacggguccgcgucgggcaaggccgacaccaagauccucuucaucgaggagggcaagaucgugcacaccagcacccuguccgggagcgcccagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccucgucccacugccucgaccccaacaacgaggagggcggccacggggucaagggcugggccuucgacgacgggaacgacguguggaugggccggaccaucagcgagaagcugcgccugggcuacgagaccuucaaggucaucgaggggugguccaaccccaacucgaagcuccagaccaaccgccaggugaucguggaccggggcaaccgguccggguacagcggcaucuucuccgucgagggcaagucgugcaucaaccgcugcuucuacguggagcugauccgggggcgcaaggaggagacggaggugcuguggaccagcaacuccaucgucguguucugcggcaccagcgggaccuacggcacgggguccuggccggacggcgccgacaucaaccucaugcccaucuga

SEQ ID NO: 26937 - RNA, 1410 nt, Artificial Sequence; identical to SEQ ID NO: 17114
  derived and/or modified CDS sequence (AUadapt) from InfluenzaA__AHL89345__NA

SEQ ID NO: 26938 - RNA, 1410 nt, Artificial Sequence; identical to SEQ ID NO: 18108
  derived and/or modified CDS sequence (AUadapt) from InfluenzaA__AHL89357__NA

SEQ ID NO: 26939 - RNA, 1410 nt, Artificial Sequence; identical to SEQ ID NO: 18109
  derived and/or modified CDS sequence (AUadapt) from InfluenzaA__AHL89369__NA

SEQ ID NO: 26940 - RNA, 1410 nt, Artificial Sequence
  derived and/or modified CDS sequence (AUadapt) from InfluenzaA__AHL89381__NA
augaaccccaaccagaagaucaucaccaucggcucggugucccugaccaucagcacgaucugcuucuucaugcagaucgccauccucaucaccaccgucacccugcacuucaagcaguacgaguacaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucucggagaagcugcgccugggcuacgagaccuucaaggucaucgaggggugguccaaccccaacagcaagcuccagaccaaccgccaggugaucguggaccggggcaaccgguccggguacucgggcaucuucuccgucgagggcaagagcugcaucaaccgcugcuucuacguggagcugauccgggggcgcaaggaggagaccgaggugcuguggaccucgaacuccaucgucguguucugcggcacgagcgggaccuacggcaccggguccuggccggacggcgccgacaucaaccucaugcccaucuga

SEQ ID NO: 26941 - RNA, 1410 nt, Artificial Sequence; identical to SEQ ID NO: 26931
  derived and/or modified CDS sequence (AUadapt) from InfluenzaA__AHL89405__NA

SEQ ID NO: 26942 - RNA, 1410 nt, Artificial Sequence
  derived and/or modified CDS sequence (AUadapt) from InfluenzaA__AHL89417__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccucguucaucuacaacgggcgccugguggacuccgucgugagcugguccaaggacauccugcggacccaggagucggagugcgugugcaucaacggcacgugcaccgucgugaugaccgacggguccgccagcggcaaggccgacaccaagauccucuucaucgaggagggcaagaucgugcacacgagcacccuguccgggucggcgcagcacgucgaggagugcuccugcuacccccgcuaccccggcgugcggugcgugugccgcgacaacuggaaggggagcaaccggccgaucgucgacaucgacaucaagaacuacuccaucgugucguccuacgugugcagcggccuggucggcgacacgccccgcaagaccgacuccucguccagcucccacugccucgaccccaacaacgaggagggcgggcacggggugaagggcugggccuucgacgacgggaacgacgucuggaugggccggaccaucagcgagaagcugcgccugggcuacgagaccuucaaggugaucgaggggugguccaaccccaacucgaagcuccagaucaaccgccaggugaucgucgaccggggcaaccgguccggguacagcggcaucuucuccguggagggcaagucgugcaucaaccgcugcuucuacguggagcugauccgggggcgcaaggaggagaccgagguccuguggaccagcaacuccaucgugguguucugcggcacgagcgggaccuacggcaccggguccuggccggacggcgccgacaucaaccucaugcccaucuga

SEQ ID NO: 26943 - RNA, 1410 nt, Artificial Sequence; identical to SEQ ID NO: 18109
  derived and/or modified CDS sequence (AUadapt) from InfluenzaA__AHL89429__NA

SEQ ID NO: 26944 - RNA, 1410 nt, Artificial Sequence; identical to SEQ ID NO: 17114
  derived and/or modified CDS sequence (AUadapt) from InfluenzaA__AHL89441__NA

SEQ ID NO: 26945 - RNA, 1410 nt, Artificial Sequence; identical to SEQ ID NO: 17114
  derived and/or modified CDS sequence (AUadapt) from InfluenzaA__AHL89453__NA

SEQ ID NO: 26946 - RNA, 1410 nt, Artificial Sequence
  derived and/or modified CDS sequence (AUadapt) from InfluenzaA__AHL89465__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaucaccaucgagaaggagaagugccccaagcuggccgaguaccggaacuggucgaagccgcagugcaacaucacgggguucgcgcccuucuccaaggacaacagcauccgccuguccgccggcggggacaucugggucacccgggagcccuacgugucgugcgaccccgaccgcugcuaccaguucgcccucggccaggggaccacccugaacaacgugcacuccaacgacacgguccacgaccggaccccguaccgcacccugcucaugaacgagcugggcgugcccuuccaccugggcaccaagcaggucugcaucgccuggagcuccucguccugccacgacgggaaggccuggcuccacgugugcgugacgggcgacgacaagaacgcgaccgccagcuucaucuacaacgggcggcugguggacuccaucgucucgugguccaaggagauccugcgcacccaggagagcgagugcgugugcaucaacgggaccugcacgguggucaugaccgacggguccgccucgggcaaggccgacaccaagauccucuucaucgaggagggcaagaucgugcacaccagcacgcuguccgggagcgcgcagcacguggaggagugcuccugcuacccccgguaccccggcguccgcugcgugugccgggacaacuggaaggggucgaaccgcccgaucguggacaucaacaucaaggacuacuccaucgucagcuccuacgugugcucgggccuggugggcgacacgccccggaagaacgacuccagcuccucgucccacugccucgaccccaacaacgaggagggcggccacggggucaagggcugggccuucgacgacgggaacgacguguggaugggccgcaccaucagcgagaagcugcggcugggcuacgagaccuucaaggucaucgaggggugguccaaccccaacucgaagcuccagaccaaccgccaggugaucguggaccggggcaaccgcuccggguacagcggcaucuucuccgucgagggcaagucgugcaucaaccggugcuucuacguggagcugauccgcgggcggaaggaggagaccgaggugcuguggaccagcaacuccaucgucguguucugcggcaccagcgggacguacggcaccggguccuggccggacggcgccgacaucaaccucaugcccaucuga

SEQ ID NO: 26947 - RNA, 1410 nt, Artificial Sequence; identical to SEQ ID NO: 26921
  derived and/or modified CDS sequence (AUadapt) from InfluenzaA__AHL89477__NA

SEQ ID NO: 26948 - RNA, 1410 nt, Artificial Sequence
  derived and/or modified CDS sequence (AUadapt) from InfluenzaA__AHL89489__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcuccaucaccggguucgcgcccuucagcaaggacaacuccauccgccugucggccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccucguccagcugccacgacgggaaggccuggcuccacgugugcgugaccggcgacgacaagaacgcgaccgccuccuucaucuacaacgggcgccugguggacagcaucgucuccuggucgaaggagauccugcggacccaggaguccgagugcgugugcaucaacggcacgugcaccguggucaugaccgacgggagcgccucgggcaaggccgacaccaagauccucuucaucgaggagggcaagaucgugcacacguccacccugagcggguccgcgcagcacguggaggagugcucgugcuacccccgcuaccccggcguccggugcgugugccgcgacaacuggaagggguccaaccggccgaucguggacaucaacaucaaggacuacagcaucgucuccucguacgugugcuccggccuggugggcgacacgccccgcaagaacgaccggagcuccagcucccacugccucgaccccaacaacgaggagggcgggcacggggucaagggcugggccuucgacgacgggaacgacguguggaugggccgcaccaucucggagaagucccggagcggcuacgagaccuucaaggucaucgaggggugguccaacccccacucgaagcugcagaucaaccgccaggugaucguggaccggggcaaccgcuccggguacagcggcaucuucucggucgaggggaaguccugcaucaaccggugcuucuacguggagcugauccgcggccggaaggaggagaccgaggugcucuggaccagcaacuccaucgucguguucugcggcaccagcgggacguacggcaccggguccuggccggacggcgccgacaucaaccugaugcccaucuga

SEQ ID NO: 26949 - RNA, 1410 nt, Artificial Sequence; identical to SEQ ID NO: 18109
  derived and/or modified CDS sequence (AUadapt) from InfluenzaA__AHL89501__NA

SEQ ID NO: 26950 - RNA, 1410 nt, Artificial Sequence; identical to SEQ ID NO: 18109
  derived and/or modified CDS sequence (AUadapt) from InfluenzaA__AHL89513__NA

SEQ ID NO: 26951 - RNA, 1410 nt, Artificial Sequence; identical to SEQ ID NO: 18109
  derived and/or modified CDS sequence (AUadapt) from InfluenzaA__AHL89525__NA

SEQ ID NO: 26952 - RNA, 1410 nt, Artificial Sequence; identical to SEQ ID NO: 18109
  derived and/or modified CDS sequence (AUadapt) from InfluenzaA__AHL89537__NA

SEQ ID NO: 26953 - RNA, 1413 nt, Artificial Sequence
  derived and/or modified CDS sequence (AUadapt) from InfluenzaA__AHL89549__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagcaccuggacuaccagaucggcuacaucugcucgggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggucgggguacagcggcuccuucguccagcaccccgagcucaccggccuggacugcauccgccccugcuucuggguggagcugguccgggggcucccgcgcgagaacaccaccaucuggacgucgggcuccagcaucuccuucugcgggguggacagcgacaccgccaacugguccuggcccgacggcgccgagcugcccuucaccaucgacaaguga

SEQ ID NO: 26954 - RNA, 1413 nt, Artificial Sequence; identical to SEQ ID NO: 18432
  derived and/or modified CDS sequence (AUadapt) from InfluenzaA__AHL89561__NA

SEQ ID NO: 26955 - RNA, 1413 nt, Artificial Sequence; identical to SEQ ID NO: 18432
  derived and/or modified CDS sequence (AUadapt) from InfluenzaA__AHL89573__NA

SEQ ID NO: 26956 - RNA, 1413 nt, Artificial Sequence; identical to SEQ ID NO: 18467
  derived and/or modified CDS sequence (AUadapt) from InfluenzaA__AHL89585__NA

SEQ ID NO: 26957 - RNA, 1413 nt, Artificial Sequence
  derived and/or modified CDS sequence (AUadapt) from InfluenzaA__AHL89597__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccguccgcgaccggucgcccuaccgcgcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcggauccugcgcacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccaggugggcuacaucugcucgggcguguucggggacaacccccggcccaaggacggcaagggguccugcaacccgaugacggucgacggcgcggacggggugaagggcuucagcuacaaguacggcaacgggguguggaucggccgcaccaaguccaacaagcugcggaagggguucgagaugaucugggaccccaacggcuggaccgacaccgacagcgacuucuccgucaagcaggacgugguggccaucacggacuggucgggguacagcggcuccuucguccagcaccccgagcucaccggccuggacugcauccgccccugcuucuggguggagcugguccgggggcucccgcgcgagaacaccaccaucuggacgucgggcuccagcaucuccuucugcgggguggacagcgacaccgccaacugguccuggcccgacggcgccgagcugcccuucaccaucgacaaguga

SEQ ID NO: 26958 - RNA, 1413 nt, Artificial Sequence; identical to SEQ ID NO: 18467
  derived and/or modified CDS sequence (AUadapt) from InfluenzaA__AHL89609__NA

SEQ ID NO: 26959 - RNA, 1413 nt, Artificial Sequence
  derived and/or modified CDS sequence (AUadapt) from InfluenzaA__AHL89621__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcucgaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccucgccguacaacuccaaguucgagagcguggccugguccgccucggccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcucgugcuucaccaucaugacggacgggcccuccaacggcgccgccagcuacaagaucuucaagaucgagaaggggaaggucaccaaguccaucgagcucaacgcccccaacuuccacuacgaggagugcagcugcuacccggacaccggcaccgugaugugcgugugccgcgacaacuggcacggguccaaccggcccugggucucguucaaccagaaccuggacuaccagaucggcuacaucugcuccggcguguucggggacaacccccgccccaaggacggcaaggggagcugcaacccggugacggucgacggcgcggacggggugaagggcuucuccuacaaguacggcaacgggguguggaucggccggaccaagucgaaccgccaccggaagggguucgagaugaucugggaccccaacggcuggaccgacaccgacuccgacuucagcgucaagcaggacgugguggccaucacggacuggucgggguacuccggcagcuucguccagcaccccgagcugaccggccucgacugcauccgccccugcuucuggguggagcugguccgggggcugccgcgcgagaacaccaccaucuggacguccggcucguccaucagcuucugcgggguggacuccgacaccgccaacuggagcuggcccgacggcgccgagcuccccuucaccaucgacaaguga

SEQ ID NO: 26960 - RNA, 1413 nt, Artificial Sequence; identical to SEQ ID NO: 18458
  derived and/or modified CDS sequence (AUadapt) from InfluenzaA__AHL89633__NA

SEQ ID NO: 26961 - RNA, 1413 nt, Artificial Sequence; identical to SEQ ID NO: 18467
  derived and/or modified CDS sequence (AUadapt) from InfluenzaA__AHL89645__NA

SEQ ID NO: 26962 - RNA, 1413 nt, Artificial Sequence; identical to SEQ ID NO: 18432
  derived and/or modified CDS sequence (AUadapt) from InfluenzaA__AHL89657__NA

SEQ ID NO: 26963 - RNA, 1413 nt, Artificial Sequence
  derived and/or modified CDS sequence (AUadapt) from InfluenzaA__AHL89669__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccaggugggcuacaucugcucgggcguguucggggacaacccccgccccaaggacggcaagggguccugcaacccgaugacggucgacggcgcggacggggugaagggcuucagcuacaaguacggcaacgggguguggaucggccggaccaaguccaacgagcugcgcaagggguucgagaugaucugggaccccaacggcuggaccgacaccgacagcgacuucuccgucaagcaggacgugguggccaucacggacuggucgggguacagcggcuccuucguccagcaccccgagcucaccggccuggacugcauccggcccugcuucuggguggagcugguccgcgggcucccgcgggagaacaccaccaucuggacgucgggcuccagcaucuccuucugcgggguggacagcgacaccgccaacugguccuggcccgacggcgccgagcugcccuucaccaucgacaaguga

SEQ ID NO: 26964 - RNA, 1413 nt, Artificial Sequence
  derived and/or modified CDS sequence (AUadapt) from InfluenzaA__AHL89681__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaagaucaccaagucgaucgagcucaacgcccccaacuuccacuacgaggagugcuccugcuacccggacaccggcaccgucaugugcgugugccgcgacaacuggcacgggagcaaccggcccuggguguccuucaaccagaaccuggacuaccaggucggcuacaucugcucgggcguguucggggacaacccccgccccaaggacggcaagggguccugcaacccgaugacgguggacggcgcggacggggucaagggcuucagcuacaaguacggcaacgggguguggaucggccggaccaaguccaacaagcugcgcaagggguucgagaugaucugggaccccaacggcuggaccgacaccgacagcgacuucuccgugaagcaggacgucguggccaucacggacuggucgggguacagcggcuccuucgugcagcaccccgagcucaccggccuggacugcauccggcccugcuucugggucgagcuggugcgcgggcucccgcgggagaacgccaccaucuggaccucgggcuccagcaucuccuucugcggggucgacagcgacacggccaacugguccuggcccgacggcgccgagcugcccuucaccaucgacaaguga

SEQ ID NO: 26965 - RNA, 1413 nt, Artificial Sequence
  derived and/or modified CDS sequence (AUadapt) from InfluenzaA__AHL89693__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaagggcaucaucacgggcaccaucaaguccuggcgcaagcagauccugcggacccaggagagcgagugcgugugcaugaacggguccugcuucaccaucaugacggacggccccucgaacggggccgccuccuacaagaucuucaagaucgagaagggcaaggugaccaagagcaucgagcucaacgcccccaacuuccacuacgaggagugcuccugcuacccggacaccgggaucgucaugugcgugugccgcgacaacuggcacggcagcaaccggcccuggguguccuucaaccagaaccuggacuaccagaucggcuacaucugcucgggggucuucggcgacaacccccgccccaaggacggggagggcuccugcaacccggugaccguggacggggcggacggcgucaagggcuucagcuacaaguacgacgacgggguguggaucggccggacgaaguccaaccgccugcggaagggguucgagaugaucugggaccccaacggcuggaccaacaccgacucggacuucuccgugaagcaggacgucguggccaucaccgacuggagcggguacagcggcuccuucgugcagcaccccgagcucacgggccuggacugcauccgccccugcuucugggucgagcuggugcgggggcucccgcgcgagaacaccaccaucuggaccucgggcuccagcaucuccuucugcggggucaacagcgacacggccaacugguccuggcccgacggcgccgagcugcccuucaccaucgacaaguga

SEQ ID NO: 26966 - RNA, 1413 nt, Artificial Sequence
  derived and/or modified CDS sequence (AUadapt) from InfluenzaA__AHL89705__NA
augaaccccaaccagaagaucaucaccaucggcucgaucuccaucgccaucgggaucaucagccugaugcuccagaucggcaacaucaucuccaucugggccucgcacuccauccagaacgggagccagaaccacaccggcaucugcaaccagcgcaucaucacguacgagaacuccaccugggugaaccacaccuacgucucgaucaacaacaccaacgugguggcggggaaggacaagacguccgucacccuggccggcaacagcucccugugcagcaucuccggcugggccaucuacaccaaggacaacucgauccggaucggguccaagggcgacguguucgugauccgcgagccguucaucagcugcucccaccucgagugccggaccuucuuccugacgcagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucaccgagacgaucaagucguggaagaagcgcauccugcggacccaggaguccgagugcgugugcgugaacggcagcugcuucaccaucaugaccgacgggcccuccaacggcgccgccagcuacaagaucuucaagaucgagaaggggaaggucacgaaguccaucgagcucaacgcccccaacuuccacuacgaggagugcucgugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggucgugcaacccggugaccgucgacggcgcggacggggugaagggcuucuccuacaaguacggcaacgggguguggaucggccggaccaagagcaaccgccugcggaagggguucgagaugaucugggaccccaacggcuggacggacaccgacuccgacuucagcgucaagcaggacgugguggccaucaccgacuggucgggguacuccggcagcuucguccagcaccccgagcucacgggccuggacugcauccgccccugcuucuggguggagcugguccgggggcucccgcgcgagaacaccaccaucuggaccuccggcucguccaucagcuucugcgggguggacuccgacacggccaacuggagcuggcccgacggcgccgagcugcccuucaccaucgacaaguga

SEQ ID NO: 26967 - RNA, 1413 nt, Artificial Sequence; identical to SEQ ID NO: 18432
  derived and/or modified CDS sequence (AUadapt) from InfluenzaA__AHL89717__NA

SEQ ID NO: 26968 - RNA, 1413 nt, Artificial Sequence; identical to SEQ ID NO: 18432
  derived and/or modified CDS sequence (AUadapt) from InfluenzaA__AHL89729__NA

SEQ ID NO: 26969 - RNA, 1413 nt, Artificial Sequence
  derived and/or modified CDS sequence (AUadapt) from InfluenzaA__AHL89753__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaacgacaagaccuccgucacccuggccggcaacagcucccugugcagcaucuccggcugggccaucuacaccaaggacaacucgauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacggagaccaucaagucguggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcucgugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggucgugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggucgggguacuccggcagcuucguccagcaccccgagcucaccggccuggacugcauccgccccugcuucuggguggagcugguccgggggcucccgcgcgagaacaccaccaucuggacguccggcucguccaucagcuucugcgggguggacuccgacaccgccaacuggagcuggcccgacggcgccgagcugcccuucaccaucgacaaguga

SEQ ID NO: 26970 - RNA, 1413 nt, Artificial Sequence; identical to SEQ ID NO: 18432
  derived and/or modified CDS sequence (AUadapt) from InfluenzaA__AHL89765__NA

SEQ ID NO: 26971 - RNA, 1413 nt, Artificial Sequence; identical to SEQ ID NO: 18473
  derived and/or modified CDS sequence (AUadapt) from InfluenzaA__AHL89777__NA

SEQ ID NO: 26972 - RNA, 1413 nt, Artificial Sequence; identical to SEQ ID NO: 18432
  derived and/or modified CDS sequence (AUadapt) from InfluenzaA__AHL89789__NA

SEQ ID NO: 26973 - RNA, 1413 nt, Artificial Sequence
  derived and/or modified CDS sequence (AUadapt) from InfluenzaA__AHL89801__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucgcccuggccggcaacuccagccugugcuccaucagcggcugggccaucuacaccaaggacaacuccauccggaucgggucgaagggcgacguguucgugauccgcgagccguucaucuccugcagccaccucgagugccggaccuucuuccugacgcagggggcccugcucaacgacaagcacuccaacggcaccgucaaggaccgcucgcccuaccgggcgcugauguccugcccccugggggaggcccccagcccguacaacucgaaguucgaguccguggccuggagcgccuccgcgugccacgacggcaugggcuggcucaccaucgggaucagcggccccgacaacggggccguggccguccugaaguacaacggcaucaucaccgagacgaucaaguccuggaagaagcgcauccugcggacccaggagucggagugcgugugcgugaacggcuccugcuucaccaucaugaccgacgggcccagcaacggcgccgccuccuacaagaucuucaagaucgagaaggggaaggucaccaagucgaucgagcucaacgcgcccaacuuccacuacgaggagugcuccugcuacccggacacgggcaccgugaugugcgugugccgcgacaacuggcacgggagcaaccggcccugggucuccuucaaccagaaccuggacuaccagaucggcuacaucugcucgggcguguucggggacaacccccgccccaaggacggcaagggguccugcaacccggugaccgucgacggcgccgacggggugaagggcuucagcuacaaguacggcaacgggguguggaucggccggacgaaguccaaccgccugcggaagggguucgagaugaucugggaccccaacggcuggaccaacaccgacagcgacuucuccgucaagcaggacgugguggccaucaccgacuggucgggguacagcggcuccuucguccagcaccccgagcucacgggccuggacugcauccgccccugcuucuggguggagcugguccgggggcucccgcgcgagaacaccaccaucuggaccucgggcuccagcaucuccuucugcgggguggacagcgacacggccaacugguccuggcccgacggcgccgagcugcccuucaccaucgacaaguga

SEQ ID NO: 26974 - RNA, 1413 nt, Artificial Sequence
  derived and/or modified CDS sequence (AUadapt) from InfluenzaA__AHL89813__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucucgggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccucgaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggucgaaccggcccugggucuccuucaaccagaaccuggacuaccaggugggcuacaucugcagcggcguguucggggacaacccccgccccaaggacggcaagggguccugcaacccgaugacggcggacggcgccgacggggucaagggcuucucguacaaguacggcaacgggguguggaucggccggaccaaguccaacaagcugcgcaagggguucgagaugaucugggaccccaacggcuggaccgacaccgacagcgacuucuccgugaagcaggacgucguggccaucacggacuggucgggguacagcggcuccuucgugcagcaccccgagcucaccggccuggacugcauccggcccugcuucugggucgagcuggugcgcgggcucccgcgggagaacgccaccaucuggaccucgggcuccagcaucuccuucugcggggucgacagcgacacggccaacugguccuggcccgacggcgcggagcugcccuucaccaucgacaaguga

SEQ ID NO: 26975 - RNA, 1413 nt, Artificial Sequence; identical to SEQ ID NO: 18473
  derived and/or modified CDS sequence (AUadapt) from InfluenzaA__AHL89825__NA

SEQ ID NO: 26976 - RNA, 1413 nt, Artificial Sequence; identical to SEQ ID NO: 18432
  derived and/or modified CDS sequence (AUadapt) from InfluenzaA__AHL89837__NA

SEQ ID NO: 26977 - RNA, 1413 nt, Artificial Sequence
  derived and/or modified CDS sequence (AUadapt) from InfluenzaA__AHL89849__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucuacaucaacaacacgaacgugguggcggggaaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggauggucaccaagagcaucgagcucaacgcccccaacuuccacuacgaggagugcuccugcuacccggacaccggcaccgugaugugcgugugccgcgacaacuggcacgggucgaaccggcccugggucuccuucaaccagaaccuggacuaccagaucggcuacaucugcagcggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccaacaccgacucggacuucuccgucaagcaggacgugguggccaucacggacuggagcggguacagcggcuccuucguccagcaccccgagcucaccggccuggacugcauccgccccugcuucuggguggagcugguccgggggcucccgcgcgagaacaccaccaucuggacgucgggcuccagcaucuccuucugcgggguggacagcgacaccgccaacugguccuggcccgacggcgccgagcugcccuucaccaucgacaaguga

SEQ ID NO: 26978 - RNA, 1410 nt, Artificial Sequence; identical to SEQ ID NO: 18468
  derived and/or modified CDS sequence (AUadapt) from InfluenzaA__AHL89861__NA

SEQ ID NO: 26979 - RNA, 1410 nt, Artificial Sequence
  derived and/or modified CDS sequence (AUadapt) from InfluenzaA__AHL89873__NA
augaaccccaaccagaagaucaucaccaucggcucggugucccugaccaucucgacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggacgacccugaacaacgugcacuccaacgacaccguccgcgaccggaccccguaccgcacgcugcucaugaacgagcugggcgugcccuuccaccugggcaccaagcaggucugcaucgccuggucguccagcuccugccacgacgggaaggccuggcuccacgugugcaucaccggcgacgacaagaacgcgaccgccucguucaucuacaacgggcggcugguggacuccaucgugagcugguccaaggagauccugcgcacgcaggagucggagugcgucugcaucaacgggaccugcaccguggugaugaccgacggguccgccagcggcaaggccgacacgaagauccucuucaucgaggagggcaagaucguccacaccucgacccuguccgggagcgcgcagcacguggaggagugcuccugcuacccccgguaccccggcgugcgcugcgucugccgggacaacuggaaggggucgaaccgcccgaucguggacaucaacaucaaggaccacuccaucgugagcuccuacgucugcucgggccuggugggcgacacgccccggaagaacgacuccagcuccucgucccacugccucgaccccaacaacgaggagggcggccacggggugaagggcugggccuucgacgacgggaacgacgucuggaugggccgcaccaucagcgagaagucccggcugggcuacgagaccuucaaggugaucgagggguggucgaaccccaaguccaagcugcagaucaaccgccaggucaucguggacggcgggaaccggagcggcuacuccgggaucuucucgguggagggcaagagcugcaucaaccgcugcuucuacgucgagcucauccggggccgcaaggaggagaccgaggugcuguggaccuccaacucgaucguggucuucugcgggacguccggcaccuacgggaccggcagcuggccggacggggccgacaucaaccugaugcccaucuga

SEQ ID NO: 26980 - RNA, 1410 nt, Artificial Sequence; identical to SEQ ID NO: 19145
  derived and/or modified CDS sequence (AUadapt) from InfluenzaA__AHL89885__NA

SEQ ID NO: 26981 - RNA, 1410 nt, Artificial Sequence
  derived and/or modified CDS sequence (AUadapt) from InfluenzaA__AHL89897__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccaucgugagcugguccaaggagauccugcgcacccaggagucggagugcgucugcaucaacggcacgugcaccguggugaugaccgacggguccgccagcggcaaggccgacaccaagauccucuucaucgaggagggcaagaucguccacacgucgacccuguccgggagcgcgcagcacguggaggagugcuccugcuacccccgguaccccggcgugcgcugcgucugccgggacaacuggaaggggucgaaccgcccgaucguggacaucaacaucaaggaccacuccaucgugagcuccuacgucugcucgggccuggugggcgacacgccccggaagaacgacuccagcuccucgucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggucgaaccccaaguccaagcugcagaccaaccgccaggucaucguggaccggggcaaccgcagcggguacuccggcaucuucucgguggagggcaagagcugcaucaaccggugcuucuacgucgagcucauccgcgggcggaaggaggagaccgaggugcuguggaccuccaacucgaucguggucuucugcggcacguccgggaccuacggcaccgggagcuggccggacggcgccgacaucaaccugaugcccaucuga

SEQ ID NO: 26982 - RNA, 1410 nt, Artificial Sequence; identical to SEQ ID NO: 18804
  derived and/or modified CDS sequence (AUadapt) from InfluenzaA__AHL89909__NA

SEQ ID NO: 26983 - RNA, 1410 nt, Artificial Sequence; identical to SEQ ID NO: 18443
  derived and/or modified CDS sequence (AUadapt) from InfluenzaA__AHL89921__NA

SEQ ID NO: 26984 - RNA, 1410 nt, Artificial Sequence; identical to SEQ ID NO: 18804
  derived and/or modified CDS sequence (AUadapt) from InfluenzaA__AHL89933__NA

SEQ ID NO: 26985 - RNA, 1410 nt, Artificial Sequence; identical to SEQ ID NO: 18443
  derived and/or modified CDS sequence (AUadapt) from InfluenzaA__AHL89945__NA

SEQ ID NO: 26986 - RNA, 1410 nt, Artificial Sequence
  derived and/or modified CDS sequence (AUadapt) from InfluenzaA__AHL89957__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucaaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 26987 - RNA, 1410 nt, Artificial Sequence; identical to SEQ ID NO: 18286
  derived and/or modified CDS sequence (AUadapt) from InfluenzaA__AHL89969__NA

SEQ ID NO: 26988 - RNA, 1410 nt, Artificial Sequence; identical to SEQ ID NO: 18286
  derived and/or modified CDS sequence (AUadapt) from InfluenzaA__AHL89981__NA

SEQ ID NO: 26989 - RNA, 1410 nt, Artificial Sequence
  derived and/or modified CDS sequence (AUadapt) from InfluenzaA__AHL89993__NA
augaaccccaaccagaagaucaucaccaucggcucggugucccugagcaucuccaccaucugcuucuucaugcagaucgccauccucaucacgaccgucacccugcacuucaagcaguacgaguucaacucgccgcccaacaaccaggugaugcugugcgagcccaccaucaucgagcgcaacaucacggagaucguguaccucaccaacaccaccaucgagaaggagaucugccccaagcuggccgaguaccggaacugguccaagccgcagugcgacaucacgggguucgcgcccuucagcaaggacaacuccauccgccugucggccggcggggacaucugggucacccgggagcccuacguguccugcgaccccgacaagugcuaccaguucgcccucggccaggggaccacccugaacaacgugcacagcaacgacacgguccgcgaccggaccccguaccgcacccugcucaugaacgagcugggcgugcccuuccaccugggcaccaagcaggucugcaucgccugguccucguccagcugccacgacgggaaggccuggcuccacgugugcaucacgggcgacgacaagaacgcgaccgccuccuucaucuacaacgggcggcugguggacagcaucguguccuggucgaaggagauccugcgcacccaggaguccgagugcgucugcaucaacgggaccugcacgcucgugaugaccgacgggagcgccucgggcaaggccgacaccaagauccuguucaucgaggagggcaagaucgugcacaccuccacgcugagcggguccgcgcagcacgucgaggagugcucgugcuacccccgguaccccggcgugcgcugcgugugccgggacaacuggaagggguccaaccgcccgaucgucgacaucaacaucaaggaccacagcaucguguccucguacgugugcuccggccucgucggcgacacgccccggaagaacgacagcuccagcuccucgcacugccuggaccccaacaacgaggagggcggccacggggugaagggcugggccuucgacgacgggaacgacguguggaugggccgcaccaucuccgagaagucccggcugggcuacgagaccuucaaggucaucgagggguggagcaaccccaagucgaagcuccagaucaaccgccaggugaucgucgaccggggcaaccgcuccggguacagcggcaucuucucgguggaggggaaguccugcaucaaccggugcuucuacguggagcugauccgcggccggaaggaggagaccgagguccuguggaccagcaacuccaucgugguguucugcggcaccagcgggaccuacggcacgggguccuggccggacggcgccgacaucaaccucaugcccaucuga

SEQ ID NO: 26990 - RNA, 1410 nt, Artificial Sequence
  derived and/or modified CDS sequence (AUadapt) from InfluenzaA__AHL90005__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccacgaucaucaagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugucggccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccucguccagcugccacgacgggaaggccuggcuccacgugugcgugaccggcgacgacaagaacgcgaccgccuccuucaucuacaacgggcgccugguggacagcaucgucuccuggucgaaggagauccugcggacccaggaguccgagugcgugugcaucaacggcacgugcaccguggucaugaccgacgggagcgccucgggcaaggccgacaccaagauccucuucaucgaggagggcaagaucgugcacacguccacccugagcggguccgcgcagcacguggaggagugcucgugcuacccccgcuaccccggcguccggugcgugugccgcgacaacuggaagggguccaaccggccgaucguggacaucaacaucaaggacuacagcaucgucucccgcuacgugugcucgggccuggugggcgacacgccccggaagaacgacuccuacagcuccagccacugccucgaccccaacaacgaggagggcgggcacggggucaagggcugggccuucgacgacgggaacgacguguggaugggccgcaccaucuccgagaagucccggucgggcuacgagaccuucaaggucaucgagggguggagcaaccccaacuccaagcugcagaucaaccgccaggugaucguggaccggggcaaccgcucgggguacuccggcaucuucagcgucgagggcaagucgugcaucaaccggugcuucuacguggagcugauccgcgggcggaaggaggagaccgaggugcucuggaccuccaacagcaucgucguguucugcggcaccuccgggacguacggcaccgggagcuggccggacggcgccgacaucaaccugaugcccaucuga

SEQ ID NO: 26991 - RNA, 1410 nt, Artificial Sequence; identical to SEQ ID NO: 18492
  derived and/or modified CDS sequence (AUadapt) from InfluenzaA__AHL90017__NA

SEQ ID NO: 26992 - RNA, 1410 nt, Artificial Sequence; identical to SEQ ID NO: 18443
  derived and/or modified CDS sequence (AUadapt) from InfluenzaA__AHL90029__NA

SEQ ID NO: 26993 - RNA, 1410 nt, Artificial Sequence; identical to SEQ ID NO: 18459
  derived and/or modified CDS sequence (AUadapt) from InfluenzaA__AHL90041__NA

SEQ ID NO: 26994 - RNA, 1410 nt, Artificial Sequence; identical to SEQ ID NO: 18459
  derived and/or modified CDS sequence (AUadapt) from InfluenzaA__AHL90053__NA

SEQ ID NO: 26995 - RNA, 1410 nt, Artificial Sequence; identical to SEQ ID NO: 24724
  derived and/or modified CDS sequence (AUadapt) from InfluenzaA__AHL90065__NA

SEQ ID NO: 26996 - RNA, 1410 nt, Artificial Sequence; identical to SEQ ID NO: 26986
  derived and/or modified CDS sequence (AUadapt) from InfluenzaA__AHL90077__NA

SEQ ID NO: 26997 - RNA, 1410 nt, Artificial Sequence; identical to SEQ ID NO: 18468
  derived and/or modified CDS sequence (AUadapt) from InfluenzaA__AHL90089__NA

SEQ ID NO: 26998 - RNA, 1410 nt, Artificial Sequence; identical to SEQ ID NO: 19145
  derived and/or modified CDS sequence (AUadapt) from InfluenzaA__AHL90101__NA

SEQ ID NO: 26999 - RNA, 1410 nt, Artificial Sequence; identical to SEQ ID NO: 18443
  derived and/or modified CDS sequence (AUadapt) from InfluenzaA__AHL90113__NA

SEQ ID NO: 27000 - RNA, 1413 nt, Artificial Sequence; identical to SEQ ID NO: 19034
  derived and/or modified CDS sequence (AUadapt) from InfluenzaA__AHL90125__NA

SEQ ID NO: 27001 - RNA, 1413 nt, Artificial Sequence
  derived and/or modified CDS sequence (AUadapt) from InfluenzaA__AHL90136__NA
augaaccccaaccagaagaucaucaccaucggcucgaucuccaucgccaucgggaucaucagccugaugcuccagaucggcaacaucaucuccaucugggccagccacuccauccagaccgggucgcagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucucgggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacagcaaguucgaguccguggccuggucggccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacaaggccgccuccuacaagaucuucaagaucgagaaggggaaggugaccaagagcaucgagcucaacgcccccaacuucuacuacgaggagugcuccugcuacccggacagcggcauggucaugugcgugugccgggacaacuggcacggguccaaccgccccugggugucguucaaccagaaccuggacuaccagaucggcuacaucugcuccggcgucuucggggacaacccccggcccgaggacggcgaggggagcugcaacccggugaccguggacggcgcgaacggggucaagggcuucuccuacaaguacggcaacgggguguggaucggccgcaccaagagcaaccggcugcgcaagggguucgagaugaucugggaccccaacggcuggacgaacaccgacuccgacuucucggugaagcaggacgucguggccaucaccgacuggagcggguacuccggcagcuucgugcagcaccccgagcucaccggccuggacugcauccggcccugcuucugggucgagcuggugcgcgggcucccgcgggagaacacgaccaucuggaccuccggcucguccaucagcuucugcggggucaacuccgacaccgccaacuggagcuggcccgacggcgccgagcugcccuucacgaucgacaaguga

SEQ ID NO: 27002 - RNA, 1413 nt, Artificial Sequence; identical to SEQ ID NO: 19034
  derived and/or modified CDS sequence (AUadapt) from InfluenzaA__AHL90160__NA

SEQ ID NO: 27003 - RNA, 1413 nt, Artificial Sequence
  derived and/or modified CDS sequence (AUadapt) from InfluenzaA__AHL90172__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggugaccaagucgaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgaggggaacugcaacccggugaccguggacggcgcgaacggggucaagggcuucuccuacaaguacggcaacgggguguggaucggccgcaccaagagcaaccggcugcgcaagggguucgagaugaucugggaccccaacggcuggacgaacaccgacuccgacuucagcgugaagcaggacgucguggccaucaccgacugguccggguacucgggcagcuucgugcagcaccccgagcucacgggccuggacugcauccggcccugcuucugggucgagcuggugcgcgggcucccgcgggagaacaccaccaucuggaccuccggcucguccaucagcuucugcggggucaacuccgacacggccaacuggagcuggcccgacggcgccgagcugcccuucaccaucgacaaguga

SEQ ID NO: 27004 - RNA, 1413 nt, Artificial Sequence; identical to SEQ ID NO: 19034
  derived and/or modified CDS sequence (AUadapt) from InfluenzaA__AHL90184__NA

SEQ ID NO: 27005 - RNA, 1413 nt, Artificial Sequence; identical to SEQ ID NO: 22332
  derived and/or modified CDS sequence (AUadapt) from InfluenzaA__AHL90196__NA

SEQ ID NO: 27006 - RNA, 1413 nt, Artificial Sequence; identical to SEQ ID NO: 19034
  derived and/or modified CDS sequence (AUadapt) from InfluenzaA__AHL90220__NA

SEQ ID NO: 27007 - RNA, 1413 nt, Artificial Sequence
  derived and/or modified CDS sequence (AUadapt) from InfluenzaA__AHL90232__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugaccgugaacggcgcgaacggggucaagggcuucagcuacaaguacgacaacggcguguggaucgggcgcacgaaguccaaccggcugcgcaagggcuucgagaugaucugggaccccaacggguggaccaacaccgacucggacuucuccgugaagcaggacgucguggccaucaccgacuggagcggcuacagcggguccuucgugcagcaccccgagcucacgggccuggacugcauccggcccugcuucugggucgagcuggugcgcggccucccgcgggagaacaccaccaucuggaccucgggguccagcaucuccuucugcggcgucaacagcgacacggccaacugguccuggcccgacggggccgagcugcccuucaccaucgacaaguga

SEQ ID NO: 27008 - RNA, 1413 nt, Artificial Sequence
  derived and/or modified CDS sequence (AUadapt) from InfluenzaA__AHL90244__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagucgaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccgaugaccguggacggcgcgaacggggugaagggcuucagcuacaaguacgacaacggcgucuggaucgggcgcacgaaguccaaccggcugcgcaagggcuucgagaugaucugggaccccaacggguggaccaacaccgacagcgacuucuccgugaagcaggacguggucgccaucaccgacuggucgggcuacagcggguccuucgugcagcaccccgagcucacgggccuggacugcauccggcccugcuucuggguggagcugguccgcggccucccgcgggagaacaccaccaucuggaccagcggguccucgaucuccuucugcggcgugaacagcgacacggccuccuggagcuggcccgacggggccgagcugcccuucaccaucgacaaguga

SEQ ID NO: 27009 - RNA, 1413 nt, Artificial Sequence; identical to SEQ ID NO: 19863
  derived and/or modified CDS sequence (AUadapt) from InfluenzaA__AHL90256__NA

SEQ ID NO: 27010 - RNA, 1413 nt, Artificial Sequence
  derived and/or modified CDS sequence (AUadapt) from InfluenzaA__AHL90268__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacaaggccgccuccuacaagaucuucaagaucgagaaggggaaggugaccaagagcaucgagcucaacgcccccaacuuccacuacgaggagugcuccugcuacccggacaccagcaucgucaugugcgugugccgggacaacuggcacggcuccaaccgccccugggugucguucaaccagaaccuggacuaccagaucggguacaucugcuccggcgucuucggcgacaacccccggcccgaggacggggagggcagcugcaacccggugaccguggacggggcgaacggcgucaagggguucuccuacaaguacgacaacggcguguggaucggccgcaccaagucgaaccggcugcgcaagggguucgagaugaucugggaccccaacggcuggacgaacaccgaccgggacuucuccgugaagcaggacgucguggccaucaccgacuggagcggguacagcggcuccuucgugcagcaccccgagcucacggggcuggacugcauccgccccugcuucugggucgagcuggugcggggccucccgcgcgagaacaccaccaucuggaccucgggcuccagcaucuccuucugcggggucaacagcgacacggccaacugguccuggcccgacggcgccgagcugcccuucaccaucgacaaguga

SEQ ID NO: 27011 - RNA, 1413 nt, Artificial Sequence; identical to SEQ ID NO: 19863
  derived and/or modified CDS sequence (AUadapt) from InfluenzaA__AHL90280__NA

SEQ ID NO: 27012 - RNA, 1413 nt, Artificial Sequence
  derived and/or modified CDS sequence (AUadapt) from InfluenzaA__AHL90304__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacggagaucugcaaccagcgcaucaucaccuacgagaacuccaccugggugaaccacaccuacgucaacaucaacaacacgaacgugguggcgggcgaggacaagaccagcgucacccuggccgggaacuccucgcugugcuccaucagcggcugggccaucuacaccaaggacaacuccauccggaucggcucgaagggggacguguucgugauccgcgagccguucaucuccugcagccaccucgagugccggacguucuuccugacccagggcgcccugcucaacgacaagcacuccaacgggaccgucaaggaccgcagccccuaccgggcccugauguccugcccccugggcgaggcgcccucgccguacaacagcaaguucgaguccguggccuggagcgccuccgccugccacgacgggaugggcuggcucaccaucggcaucucggggcccgacaacggcgcgguggccguccugaaguacaacgggaucaucacgggcaccaucaaguccuggaagaagcagauccugcgcacccaggagagcgagugcgugugcaugaacggcuccugcuucaccaucaugacggacgggcccucgaacaaggccgccuccuacaagaucuucaagaucgagaagggcaaggugaccaagagcaucgagcucaacgcccccaacuuccacuacgaggagugcuccugcuacccggacaccgggaucgucaugugcgugugccgggacaacuggcacggcagcaaccgccccuggguguccuucaaccagaaccuggacuaccagaucggguacaucugcucgggcgucuucggcgacaacccccggcccgaggacggggagggcuccugcaacccggugaccguggacggggcgaacggcgucaagggguucagcuacaaguacgacaacggcguguggaucggccgcacgaaguccaaccggcugcgcaagggguucgagaugaucugggaccccaacggcuggaccaacaccgacucggacuucuccgugaagcaggacgucguggccaucaccgacuggagcggguacagcggcuccuucgugcagcaccccgagcucacggggcuggacugcauccggcccugcuucugggucgagcuggugcgcggccucccgcgggagaacaccaccaucuggaccucgggcuccagcaucuccuucugcggggucaacagcgacacggccaacugguccuggcccgacggcgccgagcugcccuucaccaucgacaaguga

SEQ ID NO: 27013 - RNA, 1413 nt, Artificial Sequence; identical to SEQ ID NO: 19034
  derived and/or modified CDS sequence (AUadapt) from InfluenzaA__AHL90316__NA

SEQ ID NO: 27014 - RNA, 1413 nt, Artificial Sequence
  derived and/or modified CDS sequence (AUadapt) from InfluenzaA__AHL90328__NA
augaaccccaacaagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugaccguggacggcgcgaacggggucaagggcuucagcuacaaguacgacaacggcguguggaucgggcgcacgaaguccaaccggcugcgcaagggcuucgagaugaucugggaccccaacggguggaccaacaccgacucggacuucuccgugaagcaggacgucguggccgugaccgacuggagcggcuacagcggguccuucguccagcaccccgagcucacgggccuggacugcauccggcccugcuucuggguggagcugguccgcggccucccgcgggagaacaccaccaucuggaccucgggguccagcaucuccuucugcggcgugaacagcgacacggccaacugguccuggcccgacggggccgagcugcccuucaccaucgacaaguga

SEQ ID NO: 27015 - RNA, 1413 nt, Artificial Sequence; identical to SEQ ID NO: 19034
  derived and/or modified CDS sequence (AUadapt) from InfluenzaA__AHL90340__NA

SEQ ID NO: 27016 - RNA, 1413 nt, Artificial Sequence
  derived and/or modified CDS sequence (AUadapt) from InfluenzaA__AHL90352__NA
augaaccccaaccagaagaucaugaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagucgaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcagcccggugaccguggacggcgcgaacggggucaagggcuucuccuacaaguacgacaacggcguguggaucgggcgcaccaagagcaaccggcugcgcaagggcuucgagaugaucugggaccccaacggguggacgaacaccgacuccgacuucucggugaagcaggacgucguggccaucaccgacuggagcggcuacuccgggagcuucgugcagcaccccgagcucacgggccuggacugcauccggcccugcuucugggucgagcuggugcgcggcaugccgcgggagaacaccaccaucuggaccuccgggucguccaucagcuucugcggcgucaacuccgacacggccaacuggagcuggcccgacggggccgagcuccccuucaccaucgacaaguga

SEQ ID NO: 27017 - RNA, 1413 nt, Artificial Sequence; identical to SEQ ID NO: 25863
  derived and/or modified CDS sequence (AUadapt) from InfluenzaA__AHL90364__NA

SEQ ID NO: 27018 - RNA, 1413 nt, Artificial Sequence; identical to SEQ ID NO: 19863
  derived and/or modified CDS sequence (AUadapt) from InfluenzaA__AHL90376__NA

SEQ ID NO: 27019 - RNA, 1410 nt, Artificial Sequence
  derived and/or modified CDS sequence (AUadapt) from InfluenzaA__AHL90388__NA
augaaccccaaccagaagaucaucaccaucggcucggugucccugaucaucagcaccaucugcuucuucaugcagaucgccauccucaucacgaccgucacccugcacuucaagcaguacgaguucaacuccucgccgaacaaccaggugaugcugugcgagcccaccaucaucgagcgcaacaucacggagaucguguaccucaccaacaccaucaucgagaaggagaucugccccaagcuggccgaguaccggaacugguccaagccccagugcgacaucaccggguucgcgccguucagcaaggacaacuccauccgccugagcgccggcggggacaucugggucacgcgggagcccuacguguccugcgaccccgacaagugcuaccaguucgcccucggccaggggaccacccugaacaacgugcacucgaacaacaccguccgcgaccggacgcccuaccgcacccugcucaugaacgagcugggcgugccguuccaccugggcaccaagcaggucugcaucgccugguccagcuccagcugccacgacgggaaggccuggcuccacgugugcaucaccggcgacgacaagaacgcgacggccuccuucaucuacaacgggcggcugguggacucgaucguguccuggagcaaggagauccugcgcacccaggaguccgagugcgucugcaucaacgggaccugcaccguggugaugacggacgggagcgccucgggcaaggccgacaccaagauccucuucaucgaggagggcaagaucguccacaccuccacccugagcggguccgcgcagcacguggaggagugcucgugcuacccccgguaccccggcgugcgcugcgucugccgggacaacuggaagggguccaaccgccccaucguggacaucaacaucaaggaccacagcaucguguccagcuacgucugcuccggccuggugggcgacacgccgcggaagaacgacucguccagcuccagccacugccucgaccccaacaacgaggagggcggccacggggugaagggcugggccuucgacgacgggaacgacgucuggaugggccgcaccaucuccgagaagucccggcugggcuacgagaccuucaaggugaucgagggguggucgaaccccaagagcaagcugcagaucaaccgccaggucaucguggaccggggcaaccgcuccggguacagcggcaucuucucgguggaggggaaguccugcaucaaccggugcuucuacgucgagcucauccgcggccggaaggaggagaccgaggugcuguggacgagcaacuccaucguggucuucugcggcaccagcgggaccuacggcaccggguccuggcccgacggcgccgacaucaaccugaugccgaucuga

SEQ ID NO: 27020 - RNA, 1410 nt, Artificial Sequence; identical to SEQ ID NO: 18914
  derived and/or modified CDS sequence (AUadapt) from InfluenzaA__AHL90400__NA

SEQ ID NO: 27021 - RNA, 1410 nt, Artificial Sequence; identical to SEQ ID NO: 18914
  derived and/or modified CDS sequence (AUadapt) from InfluenzaA__AHL90413__NA

SEQ ID NO: 27022 - RNA, 1410 nt, Artificial Sequence
  derived and/or modified CDS sequence (AUadapt) from InfluenzaA__AHL90425__NA
augaaccccaaccagaagaucaucaccaucggcucggugucccugaccaucucgacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggacgacccugaacaacgugcacuccaacgacaccguccacgaccgcaccccguaccggacgcugcucaugaacgagcugggcgugcccuuccaccugggcaccaagcaggucugcaucgccuggucguccagcuccugccacgacgggaaggccuggcuccacgugugcaucaccggcgacgacaagaacgcgaccgccucguucaucuacaacgggcgccugguggacuccaucgugagcugguccaaggagauccugcggacgcaggagucggagugcgucugcaucaacgggaccugcaccguggugaugaccgacggguccgccagcggcaaggccgacacgaagauccucuucaucgaggagggcaagaucguccacaccucgacccuguccgggagcgcgcagcacguggaggagugcuccugcuacccccgcuaccccggcgugcggugcgucugccgcgacaacuggaaggggucgaaccggccgaucguggacaucaacaucaaggaccacuccaucgugagcuccuacgucugcucgggccuggugggcgacacgccccgcaagaacgacuccagcuccucgucccacugccucgaccccaacaacgaggagggcggccacggggugaagggcugggccuucgacgacgggaacgacgucuggaugggccggaccaucagcgagaagucccgccugggcuacgagaccuucaaggugaucgagggguggucgaaccccaaguccaagcugcagaucaaccggcaggucaucguggaccgcggcgaccggagcggguacuccggcaucuucucgguggagggcaagagcugcaucaaccgcugcuucuacgucgagcucauccgggggcgcaaggaggagaccgaggugcuguggaccuccaacucgaucguggucuucugcggcacguccgggaccuacggcaccgggagcuggccggacggcgccgacaucaaccugaugcccaucuga

SEQ ID NO: 27023 - RNA, 1410 nt, Artificial Sequence; identical to SEQ ID NO: 19001
  derived and/or modified CDS sequence (AUadapt) from InfluenzaA__AHL90437__NA

SEQ ID NO: 27024 - RNA, 1410 nt, Artificial Sequence; identical to SEQ ID NO: 18914
  derived and/or modified CDS sequence (AUadapt) from InfluenzaA__AHL90449__NA

SEQ ID NO: 27025 - RNA, 1410 nt, Artificial Sequence; identical to SEQ ID NO: 18914
  derived and/or modified CDS sequence (AUadapt) from InfluenzaA__AHL90461__NA

SEQ ID NO: 27026 - RNA, 1410 nt, Artificial Sequence; identical to SEQ ID NO: 18914
  derived and/or modified CDS sequence (AUadapt) from InfluenzaA__AHL90473__NA

SEQ ID NO: 27027 - RNA, 1410 nt, Artificial Sequence; identical to SEQ ID NO: 18914
  derived and/or modified CDS sequence (AUadapt) from InfluenzaA__AHL90485__NA

SEQ ID NO: 27028 - RNA, 1410 nt, Artificial Sequence; identical to SEQ ID NO: 19005
  derived and/or modified CDS sequence (AUadapt) from InfluenzaA__AHL90497__NA

SEQ ID NO: 27029 - RNA, 1410 nt, Artificial Sequence; identical to SEQ ID NO: 19005
  derived and/or modified CDS sequence (AUadapt) from InfluenzaA__AHL90509__NA

SEQ ID NO: 27030 - RNA, 1410 nt, Artificial Sequence
  derived and/or modified CDS sequence (AUadapt) from InfluenzaA__AHL90521__NA
augaaccccaaccagaagaucaucaccaucggcucggugucccugaccaucagcacgaucugcuucuuccuccagaucgccauccugaucaccaccgucacccugcacuucaagcaguacgaguucaacuccccgcccaacaaccaggugaugcucugcgagcccacgaucaucgagcgcaacaucaccgagaucguguaccugaccaacaccacgaucgagaaggagaucugccccaagcuggccgaguaccggaacuggucgaagccgcagugcgacaucaccggguucgcgcccuucuccaaggacaacagcauccgccucuccgccggcggggacaucugggucacccgggagcccuacgugucgugcgaccccgacaagugcuaccaguucgcccugggccaggggaccacgcugaacaacgugcacuccaacaacaccguccgcgaccggaccccguaccgcacccuccugaugaacgagcugggcgugcccuuccaccucggcacgaagcaggucugcaucgccuggagcuccucguccugccacgacgggaaggccuggcugcacgugugcaucaccggcgacgacaagaacgcgaccgccagcuucaucuacaacgggcggcugguggacuccaucgugucgugguccaaggagauccuccgcacccaggagagcgagugcgucugcaucaacggcacgugcaccguggugaugaccgacggguccgccucgggcaaggccgacaccaagauccuguucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccucgugggcgacacgccccggaagaacgacuccucguccagcucccacugccuggaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcuccagaucaaccgccaggucaucguggaccggggcaaccgcucgggguacuccggcaucuucagcguggagggcaagucgugcaucaaccggugcuucuacgucgagcugauccgcgggcggaaggaggagaccgaggugcuguggaccuccaacagcaucguggucuucugcggcaccuccgggacguacggcaccgggagcuggccggacggcgccgacaucaaccucaugcccaucuga

SEQ ID NO: 27031 - RNA, 1410 nt, Artificial Sequence
  derived and/or modified CDS sequence (AUadapt) from InfluenzaA__AHL90533__NA
augaaccccaaccagaagaucaucaccaucggcucggugucccugaccaucucgacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggacgacccugaacaacgugcacuccaacgacaccguccgcgaccggaccccguaccgcacgcugcucaugaacgagcugggcgugcccuuccaccugggcaccaagcaggucugcaucgccuggucguccagcuccugccacgacgggaaggccuggcuccacgugugcaucaccggcgacgacaagaacgcgaccgccucguucaucuacaacgggcggcugguggacuccaucgugagcugguccaaggagauccugcgcacgcaggagucggagugcgucugcaucaacgggaccugcaccguggugaugaccgacggguccgccagcggcaaggccgacacgaagauccucuucaucgaggagggcaagaucguccacaccucgacccuguccgggagcgcgcagcacguggaggagugcuccugcuacccccgguaccccggcgugcgcugcgucugccgggacaacuggaaggggucgaaccgcccgaucguggacaucaacaucaaggaccacuccaucgugagcuccuacgucugcucgggccuggugggcgacacgccccggaagaacgacuccagcuccucgucccacugccucgaccccaacaacgaggagggcggccacggggugaagggcugggccuucgacgacgggaacgacgucuggaugggccgcaccaucagcgagaagucccggcugggcuacgagaccuucaaggugaucgagggguggucgaaccccaaguccaagcugcagaucaaccgccaggucaucguggagcggggcgaccgcagcggguacuccggcaucuucucgguggagggcaagagcugcaucaaccggugcuucuacgucgagcucauccgcgggcggaaggaggagaccgaggugcuguggaccuccaacucgaucguggucuucugcggcacguccgggaccuacggcaccgggagcuggccggacggcgccgacaucaaccugaugcccaucuga

SEQ ID NO: 27032 - RNA, 1410 nt, Artificial Sequence; identical to SEQ ID NO: 18914
  derived and/or modified CDS sequence (AUadapt) from InfluenzaA__AHL90545__NA

SEQ ID NO: 27033 - RNA, 1410 nt, Artificial Sequence; identical to SEQ ID NO: 19001
  derived and/or modified CDS sequence (AUadapt) from InfluenzaA__AHL90557__NA

SEQ ID NO: 27034 - RNA, 1410 nt, Artificial Sequence
  derived and/or modified CDS sequence (AUadapt) from InfluenzaA__AHL90569__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaagggguucgcgcccuucuccaaggacaacagcauccgccuguccgccggcggggacaucugggucacccgggagcccuacgugucgugcgaccccgacaagugcuaccaguucgcccucggccaggggaccacccugaacaacgugcacuccaacaacacgguccgcgaccggaccccguaccgcacccugcucaugaacgagcugggcgugcccuuccaccugggcaccaagcaggucugcaucgccuggagcuccucguccugccacgacgggaaggccuggcuccacgugugcaucacgggcgacgacaagaacgcgaccgccagcuucaucuacaacgggcggcugguggacuccguggucucgugguccaaggagauccugcgcacccaggagagcgagugcgugugcaucaacgggaccugcacgguggucaugaccgacggguccgccucgggcaaggccgacaccaagauccucuucaucgaggagggcaagaucgugcacaccagcacgcuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcggccacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggaccuacggcacggggagcuggccggacggcgccgacaucaaccugaugcccaucuga

SEQ ID NO: 27035 - RNA, 1410 nt, Artificial Sequence; identical to SEQ ID NO: 19001
  derived and/or modified CDS sequence (AUadapt) from InfluenzaA__AHL90581__NA

SEQ ID NO: 27036 - RNA, 1410 nt, Artificial Sequence; identical to SEQ ID NO: 19005
  derived and/or modified CDS sequence (AUadapt) from InfluenzaA__AHL90593__NA

SEQ ID NO: 27037 - RNA, 1410 nt, Artificial Sequence
  derived and/or modified CDS sequence (AUadapt) from InfluenzaA__AHL90605__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccaacaucaaccugaugcccaucuga

SEQ ID NO: 27038 - RNA, 1410 nt, Artificial Sequence; identical to SEQ ID NO: 19001
  derived and/or modified CDS sequence (AUadapt) from InfluenzaA__AHL90629__NA

SEQ ID NO: 27039 - RNA, 1410 nt, Artificial Sequence; identical to SEQ ID NO: 19001
  derived and/or modified CDS sequence (AUadapt) from InfluenzaA__AHL90641__NA

SEQ ID NO: 27040 - RNA, 1410 nt, Artificial Sequence; identical to SEQ ID NO: 18914
  derived and/or modified CDS sequence (AUadapt) from InfluenzaA__AHL90653__NA

SEQ ID NO: 27041 - RNA, 1410 nt, Artificial Sequence; identical to SEQ ID NO: 19001
  derived and/or modified CDS sequence (AUadapt) from InfluenzaA__AHL90665__NA

SEQ ID NO: 27042 - RNA, 1410 nt, Artificial Sequence
  derived and/or modified CDS sequence (AUadapt) from InfluenzaA__AHL90677__NA
augaaccccaaccagaagaucaucaccaucggcucggugucccugaccaucucgacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggucguccagcuccugccacgacgggaaggccuggcuccacgugugcaucaccggcgacgacaagaacgcgaccgccucguucaucuacaacgggaagcugguggacuccaucgugagcugguccaaggagauccugcggacgcaggagucggagugcgucugcaucaacgggaccugcaccguggugaugaccgacggguccgccagcggcaaggccgacacgaagauccucuucaucgaggagggcaagaucguccacaccucgacccuguccgggagcgcgcagcacguggaggagugcuccugcuacccccgcuaccccggcgugcggugcgucugccgcgacaacuggaaggggucgaaccggccgaucguggacaucaacaucaaggaccacuccaucgugagcuccuacgucugcucgggccuggugggcgacacgccccgcaagaacgacuccagcuccucgucccacugccucgaccccaacaacgaggagggcggccacggggugaagggcugggccuucgacgacgggaacgacgucuggaugggccggaccaucagcgagaagucccgccugggcuacgagaccuucaaggugaucgagggguggucgaaccccaaguccaagcugcagaucaaccggcaggucaucguggaccgcggcaaccggagcggguacuccggcaucuucucgguggagggcaagagcugcaucaaccgcugcuucuacgucgagcucauccgggggcgcaaggaggagaccgaggugcuguggaccuccaacucgaucguggucuucugcggcacguccgggaccuacggcaccgggagcuggccggacggcgccgacaucaaccugaugcccaucuga

SEQ ID NO: 27043 - RNA, 1410 nt, Artificial Sequence; identical to SEQ ID NO: 19001
  derived and/or modified CDS sequence (AUadapt) from InfluenzaA__AHL90689__NA

SEQ ID NO: 27044 - RNA, 1410 nt, Artificial Sequence
  derived and/or modified CDS sequence (AUadapt) from InfluenzaA__AHL90701__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcgggggcaucugggucacccgggagcccuacgugucgugcgaccccgacaagugcuaccaguucgcccucgggcagggcaccacgcugaacaacgugcacuccaacaacaccguccgcgaccggaccccguaccgcacccugcucaugaacgagcugggcgugcccuuccaccuggggacgaagcaggucugcaucgccuggagcuccucguccugccacgacggcaaggccuggcuccacgugugcaucaccggggacgacaagaacgcgaccgccagcuucaucuacaacggccggcugguggacuccguggucucgugguccaaggacauccugcgcacccaggagagcgagugcgugugcaucaacgggacgugcaccguggucaugaccgacggcuccgccucgggcaaggccgacaccaagauccucuucaucgaggaggggaagaucgugcacacgagcacccuguccggcucggcgcagcacguggaggagugcuccugcuacccccgguaccccgggguccgcugcgugugccgggacaacuggaagggcagcaaccgcccgaucguggacaucaacaucaaggaccacuccaucgucucguccuacgugugcagcggccuggugggggacacgccccggaagaacgacuccucguccagcucccacugccucgaccccaacaacgaggagggcgggcacggcgucaaggggugggccuucgacgacggcaacgacguguggaugggccgcaccaucucggagaagucccggcugggguacgagaccuucaaggucaucgagggcuggagcaaccccaaguccaagcugcagaucaaccgccaggugaucguggaccgggggaaccgcucgggcuacuccgggaucuucagcgucgagggcaagucgugcaucaaccggugcuucuacguggagcucauccgcggccggaaggaggagaccgaggugcuguggaccuccaacagcaucgucguguucugcgggaccuccggcacguacgggaccggcagcuggccggacggggccgacaucaaccugaugcccaucuga

SEQ ID NO: 27045 - RNA, 1410 nt, Artificial Sequence; identical to SEQ ID NO: 21706
  derived and/or modified CDS sequence (AUadapt) from InfluenzaA__AHL90713__NA

SEQ ID NO: 27046 - RNA, 1413 nt, Artificial Sequence; identical to SEQ ID NO: 22339
  derived and/or modified CDS sequence (AUadapt) from InfluenzaA__AHL90725__NA

SEQ ID NO: 27047 - RNA, 1413 nt, Artificial Sequence; identical to SEQ ID NO: 21332
  derived and/or modified CDS sequence (AUadapt) from InfluenzaA__AHL90749__NA

SEQ ID NO: 27048 - RNA, 1413 nt, Artificial Sequence; identical to SEQ ID NO: 19863
  derived and/or modified CDS sequence (AUadapt) from InfluenzaA__AHL90761__NA

SEQ ID NO: 27049 - RNA, 1413 nt, Artificial Sequence
  derived and/or modified CDS sequence (AUadapt) from InfluenzaA__AHL90773__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcaugacccuggccggcaacuccucgcugugcuccaucagcggcugggccaucuacaccaaggacaacuccauccggaucgggagcaagggcgacgucuucgugauccgcgagccguucaucuccugcucgcaccucgagugccggacguucuuccugacccagggggcccugcucaacgacaagcacuccaacggcaccgugaaggaccgcagccccuaccgggcccugauguccugcccccugggggaggcgcccagcccguacaacucgaaguucgaguccgucgccuggagcgccuccgccugccacgacggcaugggcuggcucaccaucgggaucagcggccccgacaacggggcgguggccgugcugaaguacaacggcaucaucacgggcaccaucaaguccuggaagaagcagauccugcgcacccaggagucggagugcgucugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgugaugugcgucugccgggacaacuggcacgggucgaaccgccccuggguguccuucaaccagaaccuggacuaccagaucggcuacaucugcagcggcguguucggggacaacccccggcccgaggaccgcgagggcuccugcaacccggucaccguggacggggcgaacggcgugaagggguucagcuacaaguacggcaacggcgucuggaucgggcggacgaaguccaaccgccugcggaagggcuucgagaugaucugggaccccaacggguggaccaacaccgacucggacuucuccgugaagcaggacguggucgccaucaccgacuggagcggcuacagcggguccuucgugcagcaccccgagcucacgggccuggacugcauccgccccugcuucuggguggagcugguccggggccucccgcgcgagaacaccaccaucuggaccucgggguccagcaucuccuucugcggcgugaacagcgacacggccaacugguccuggcccgacggggccgagcugcccuucaccaucgacaaguga

SEQ ID NO: 27050 - RNA, 1413 nt, Artificial Sequence
  derived and/or modified CDS sequence (AUadapt) from InfluenzaA__AHL90785__NA
augaaccccaaccagaagaucaucaccaucggcucgaucuccaucgccaucgggaucaucagccugaugcuccagaucggcaacaucaucuccaucugggccagccacuccauccagaccgggucgcagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucucgggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagucgaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccgugaacggcgcggacggggucaagggcuucucguacaaguacggcaacgggguguggaucggccgcacgaaguccaaccggcugcgcaagggguucgagaugaucugggaccccaacggcuggaccaacaccgacagcgacuucuccgugaagcaggacgucguggccaucaccgacuggagcggguacucgggcuccuucgugcagcaccccgagcucacgggccuggacugcauccggcccugcuucugggucgagcuggugcgcgggcucccgcgggagaacaucaccaucuggaccagcggcuccagcaucuccuucugcggggucaacagcgacaccgccaacugguccuggcccgacggcgccgagcugcccuucacgaucgacaaguga

SEQ ID NO: 27051 - RNA, 1413 nt, Artificial Sequence
  derived and/or modified CDS sequence (AUadapt) from InfluenzaA__AHL90797__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaacaagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggucgaagggcgacguguucgugauccgcgagccguucaucgccugcucccaccucgagugccggacguucuuccugacccagggggcccugcucaacgacaagcacagcaacggcaccgucaaggaccgcucccccuaccgggcgcugaugagcugcccccugggggaggcccccuccccguacaacucgaaguucgagagcguggccugguccgccagcgcgugccacgacggcaugggcuggcucaccaucgggaucuccggccccgacaacggggccguggccguccugaaguacaacggcaucaucacgggcaccaucaagucguggaagaagcagauccugcgcacccaggaguccgagugcgugugcaugaacgggagcugcuucaccaucaugacggacggccccuccgacaaggccgccucguacaagaucuucaagaucgagaaggggaaggugaccaaguccaucgagcucaacgcgcccaacuuccacuacgaggagugcagcugcuacccggacaccggcaucgucaugugcgugugccgggacaacuggcacggguccaaccgccccugggugagcuucaaccagaaccuggacuaccagaucggcuacaucugcuccggcgucuucggggacaacccccggcccgaggacggcgaggggucgugcuccccggugaccguggacggcgccaacggggucaagggcuucagcuacaaguacgacaacggcguguggaucgggcgcacgaaguccaaccggcugcgcaagggcuucgaggugaucugggaccccaacggguggaccaacaccgacucggacuucuccgucaagcaggacgugguggccaucaccgacuggagcggcuacagcggguccuucguccagcaccccgagcucacgggccuggacugcauccggcccugcuucuggguggagcugguccgcggccucccgcgggagaacaccaccaucuggaccucgggguccagcaucuccuucugcggcgugaacagcgacacggccaacugguccuggcccgacggggccgagcugcccuucaccaucgacaaguga

SEQ ID NO: 27052 - RNA, 1413 nt, Artificial Sequence; identical to SEQ ID NO: 19863
  derived and/or modified CDS sequence (AUadapt) from InfluenzaA__AHL90809__NA

SEQ ID NO: 27053 - RNA, 1413 nt, Artificial Sequence; identical to SEQ ID NO: 22339
  derived and/or modified CDS sequence (AUadapt) from InfluenzaA__AHL90821__NA

SEQ ID NO: 27054 - RNA, 1413 nt, Artificial Sequence
  derived and/or modified CDS sequence (AUadapt) from InfluenzaA__AHL90833__NA
augaaccccaaccagcgcaucaucaccaucggcucgaucuccaucgccaucgggaucaucagccugaugcuccagaucggcaacaucaucuccaucugggccucgcacuccauccagaccgggagccagaacaacacgggcaucugcaaccagcggaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccgcaucgggucgaagggcgacguguucgugauccgggagccguucaucuccugcagccaccucgagugccgcacguucuuccugacccagggggcccugcucaacgacaagcacuccaacggcaccgccaaggaccggagccccuaccgcgcgcugauguccugcccccugggggaggcccccucgccguacaacagcaaguucgaguccgucgccuggagcgccuccgcgugccacgacggcaugggcuggcucaccaucgggaucucgggccccgacaacggggccguggccgugcugaaguacaacggcaucaucacgggcaccaucaaguccuggaagaagcagauccugcggacccaggagagcgagugcgucugcaugaacggguccugcuucaccaucaugacggacggccccucgaacaaggccgccuccuacaagaucuucaagaucgagaaggggaaggugaccaagagcaucgagcucaacgcgcccaacuucuacuacgaggagugcuccugcuacccggacaccggcaucgugaugugcgucugccgcgacaacuggcacgggagcaaccggcccuggguguccuucaaccagaaccuggacuaccagaugggcuacaucugcucgggcguguucggggacaacccccgccccgaggacggcgagggguccugcaacccggucaccguggacggcgccaacggggugaagggcuucagcuacaaguacggcaacggggucuggaucggccggacgaaguccaaccgccugcggaagggguucgagaugaucugggaccccaacggcuggaccaacaccgacucggacuucuccgugaagcaggacguggucgccaucaccgacuggagcggguacagcggcuccuucgugcagcaccccgagcucacgggccuggacugcauccgccccugcuucuggguggagcugguccgggggcucccgcgcgagaacaccaccaucuggaccucgggcuccagcaucuccuucugcggggugaacagcgacacggccaacugguccuggcccgacggcgccgagcugcccuucaccaucgacaaguga

SEQ ID NO: 27055 - RNA, 1413 nt, Artificial Sequence; identical to SEQ ID NO: 19863
  derived and/or modified CDS sequence (AUadapt) from InfluenzaA__AHL90845__NA

SEQ ID NO: 27056 - RNA, 1413 nt, Artificial Sequence; identical to SEQ ID NO: 21332
  derived and/or modified CDS sequence (AUadapt) from InfluenzaA__AHL90857__NA

SEQ ID NO: 27057 - RNA, 1413 nt, Artificial Sequence; identical to SEQ ID NO: 19863
  derived and/or modified CDS sequence (AUadapt) from InfluenzaA__AHL90869__NA

SEQ ID NO: 27058 - RNA, 1413 nt, Artificial Sequence
  derived and/or modified CDS sequence (AUadapt) from InfluenzaA__AHL90881__NA
augaaccccaaccagaagaucaucaccaucggcucgaucuccaucgccaucgggaucaucagcaccaugcugcagaucggcuccaucaucagcaucugggccucccacucgauccagacggggucccagaacaacaccggcaucugcaaccagcgcaucaucaccuacgagaacagcaccugggugaaccacacguacgucaacaucaacaacaccaacgugguggcgggggaggacaagaccuccgucacccucgccggcaacagcucccugugcucgaucuccggcugggccaucuacacgaaggacaacagcauccggaucggguccaagggcgacguguucgugauccgcgagccguucaucagcugcucccaccuggagugccggaccuucuuccucacccagggggcccugcugaacgacaagcacucgaacggcaccgucaaggaccgcucccccuaccgggcccucaugagcugcccccugggggaggcgcccagcccguacaacuccaaguucgagucgguggccugguccgccagcgccugccacgacggcaugggcuggcugacgaucgggaucuccggccccgacaacggggcgguggccguccucaaguacaacggcaucaucaccggcaccaucaagagcuggaagaagcagauccugcgcacccaggaguccgagugcgugugcaugaacgggucgugcuucacgaucaugaccgacggccccuccaacaaggccgccagcuacaagaucuucaagaucgagaaggggaaggugaccaaguccaucgagcugaacgcccccaacuucuacuacgaggagugcagcugcuacccggacaccggcaucgucaugugcgugugccgggacaacuggcacggguccaaccgccccugggugucguucaaccagaaccucgacuaccagaucggcuacaucugcuccggcgucuucggggacaacccccggcccgaggacggcgaggggagcugcaacccggugacgguggacggcgcgaacggggucaagggcuucuccuacaaguacggcaacgggguguggaucggccgcaccaagagcaaccggcugaucaagggguucgagaugaucugggaccccaacggcuggaccaacaccgacuccgacuucucggugaagcaggacgucguggccaucacggacuggagcggguacuccggcagcuucgugcagcaccccgagcugaccggccucgacugcauccgccccugcuucugggucgagcuggugcgggggcugccgcgcgagaacaccaccaucuggacguccggcucguccaucagcuucugcggggucaacuccgacaccgccaacuggagcuggcccgacggcgccgagcuccccuucaccaucgacaaguga

SEQ ID NO: 27059 - RNA, 1413 nt, Artificial Sequence; identical to SEQ ID NO: 22339
  derived and/or modified CDS sequence (AUadapt) from InfluenzaA__AHL90893__NA

SEQ ID NO: 27060 - RNA, 1413 nt, Artificial Sequence; identical to SEQ ID NO: 21332
  derived and/or modified CDS sequence (AUadapt) from InfluenzaA__AHL90905__NA

SEQ ID NO: 27061 - RNA, 1413 nt, Artificial Sequence
  derived and/or modified CDS sequence (AUadapt) from InfluenzaA__AHL90917__NA
augaaccccaaccagaagaucaucaccaucggcucgaucuccaucgccaucgggaucaucagccugacccuccagaucggcaacaucaucuccaucugggccucgcacuccauccagacggggagccagaacaacaccggcaucugcaaccagcgcaucaucaccuacgagaacuccaccugggugaaccacacguacgucaacaucaacaacaccaacgugguggcgggggaggacaagaccagcgucacccuggccggcaacuccucgcugugcuccaucagcggcugggccaucuacacgaaggacaacuccauccggaucgggucgaagggcgacguguucgugauccgcgagccguucaucuccugcagccaccucgagugccggaccuucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucacgaucgggaucucgggccccgacaacggggcgguggccguccugaaguacaacggcaucaucaccggcaccaucaaguccuggaagaagcagauccugcgcacccaggagagcgagugcgugugcaugaacggguccugcuucacgaucaugaccgacggccccucgaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugacgguggacggcgcgaacggggucaagggcuucagcuacaaguacggcaacgggguguggaucggccgcaccaaguccaaccggcugcgcaagggguucgagaugaucugggaccccaacggcuggaccaacaccgacucggacuucuccgugaagcaggacgucguggccaucacggacuggagcggguacagcggcuccuucgugcagcaccccgagcucaccggccuggacugcauccggcccugcuucugggucgagcuggugcgcgggcucccgcgggagaacaccaccaucuggacgucgggcuccagcaucuccuucugcggggucaacagcgacaccgccaacugguccuggcccgacggcgccgagcugcccuucaccaucgacaaguga

SEQ ID NO: 27062 - RNA, 1413 nt, Artificial Sequence
  derived and/or modified CDS sequence (AUadapt) from InfluenzaA__AHL90929__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcaugacccuggccggcaacuccucgcugugcuccaucagcggcugggccaucuacaccaaggacaacuccauccggaucgggagcaagggcgacgucuucgugauccgcgagccguucaucuccugcucgcaccucgagugccggacguucuuccugacccagggggcccugcucaacgacaagcacuccaacggcaccgugaaggaccgcagccccuaccgggcccugauguccugcccccugggggaggcgcccagcccguacaacucgaaguucgaguccgucgccuggagcgccuccgccugccacgacggcaugggcuggcucaccaucgggaucagcggccccgacaacggggcgguggccgugcugaaguacaacggcaucaucacgggcaccaucaaguccuggaagaagcagauccugcgcacccaggagucggagugcgucugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgugaugugcgucugccgggacaacuggcacgggucgaaccgccccuggguguccuucaaccagaaccuggacuaccagaucggcuacaucugcagcggcguguucggggacaacccccggcccgaggacggcgagggguccugcaacccggucaccguggacggcgcgaacggggugaagggcuucagcuacaaguacggcaacggggucuggaucggccgcacgaaguccaaccggcugcgcaagggguucgagaugaucugggaccccaacggcuggaccaacaccgacucggacuucuccgugaagcaggacguggucgccaucaccgacuggagcggguacagcggcuccuucgugcagcaccccgagcucacgggccuggacugcauccggcccugcuucuggguggagcugguccgcgggcucccgcgggagaacaccaccaucuggaccucgggcuccagcaucuccuucugcggggugaacagcgacacggccaacugguccuggcccgacggcgccgagcugcccuucaccaucgacaaguga

SEQ ID NO: 27063 - RNA, 1413 nt, Artificial Sequence; identical to SEQ ID NO: 21332
  derived and/or modified CDS sequence (AUadapt) from InfluenzaA__AHL90941__NA

SEQ ID NO: 27064 - RNA, 1413 nt, Artificial Sequence; identical to SEQ ID NO: 21332
  derived and/or modified CDS sequence (AUadapt) from InfluenzaA__AHL90953__NA

SEQ ID NO: 27065 - RNA, 1413 nt, Artificial Sequence; identical to SEQ ID NO: 21332
  derived and/or modified CDS sequence (AUadapt) from InfluenzaA__AHL90965__NA

SEQ ID NO: 27066 - RNA, 1413 nt, Artificial Sequence
  derived and/or modified CDS sequence (AUadapt) from InfluenzaA__AHL90977__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggucgaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacucggacuucuccgugaagcaggacgucguggccaucgccgacuggagcggguacagcggcuccuucgugcagcaccccgagcucaccggccuggacugcauccggcccugcuucugggucgagcuggugcgcgggcucccgcgggagaacacgaccaucuggaccucgggcuccagcaucuccuucugcggggucaacagcgacaccgccaacugguccuggcccgacggcgccgagcugcccuucacgaucgacaaguga

SEQ ID NO: 27067 - RNA, 1413 nt, Artificial Sequence; identical to SEQ ID NO: 22606
  derived and/or modified CDS sequence (AUadapt) from InfluenzaA__AHL90989__NA

SEQ ID NO: 27068 - RNA, 1413 nt, Artificial Sequence; identical to SEQ ID NO: 27062
  derived and/or modified CDS sequence (AUadapt) from InfluenzaA__AHL91001__NA

SEQ ID NO: 27069 - RNA, 1413 nt, Artificial Sequence
  derived and/or modified CDS sequence (AUadapt) from InfluenzaA__AHL91013__NA
augaaccccaaccagaagaucaucaccaucggcucgaucuccaucgccaucgggaucaucagccugaugcuccagaucggcaacaucaucuccaucugggccagccacuccauccagaccgggucgcagaacaacacgggcaucugcucccagcgcaucaucaccuacgagaacagcaccugggugaaccacaccuacgucaacaucaacaacacgaacgugguggcgggggaggacaagaccuccaugacccuggccggcaacagcucccugugcucgaucuccggcugggccaucuacaccaaggacaacagcauccggaucggguccaagggcgacgucuucgugauccgcgagccguucaucagcugcucccaccucgagugccggacguucuuccugacccagggggcccugcucaacgacaagcacucgaacggcaccgugaaggaccgcucccccuaccgggcccugaugagcugcccccugggggaggcgcccagcccguacaacuccaaguucgagucggucgccugguccgccagcgccugccacgacggcaugggcuggcucaccaucgggaucuccggccccgacaacggggcgguggccgugcugaaguacaacggcaucaucacgggcaccauccgcagcuggaagaagcagauccugcggacccaggaguccgagugcgucugcaugaacgggucgugcuucaccaucaugacggacggccccuccaacaaggccgccagcuacaagaucuucaagaucgagaaggggaaggugaccaaguccaucgagcucaacgcccccaacuucuacuacgaggagugcagcugcuacccggacaccggcaucgugaugugcgucugccgcgacaacuggcacggguccaaccggcccugggugucguucaaccagaaccuggacuaccagaucggcuacaucugcuccggcguguucggggacaacccccgccccgaggacggcgaggggagcugcaacccggucaccguggacggcgcgaacggggugaagggcuucuccuacaaguacggcaacggggucuggaucggccggaccaagagcaaccgccugcggaagggguucgagaugaucugggaccccaacggcuggacgaacaccgacuccgacuucucggugaagcaggacguggucgccaucaccgacuggagcggguacuccggcagcuucgugcagcaccccgagcucacgggccuggacugcauccgccccugcuucuggguggagcugguccgggggcucccgcgcgagaacaccaccaucuggaccuccggcucguccaucagcuucugcggggugaacuccgacacggccaacuggagcuggcccgacggcgccgagcugcccuucaccaucgacaaguga

SEQ ID NO: 27070 - RNA, 1413 nt, Artificial Sequence; identical to SEQ ID NO: 27062
  derived and/or modified CDS sequence (AUadapt) from InfluenzaA__AHL91025__NA

SEQ ID NO: 27071 - RNA, 1410 nt, Artificial Sequence; identical to SEQ ID NO: 20307
  derived and/or modified CDS sequence (AUadapt) from InfluenzaA__AHL91037__NA

SEQ ID NO: 27072 - RNA, 1410 nt, Artificial Sequence; identical to SEQ ID NO: 21920
  derived and/or modified CDS sequence (AUadapt) from InfluenzaA__AHL91049__NA

SEQ ID NO: 27073 - RNA, 1410 nt, Artificial Sequence
  derived and/or modified CDS sequence (AUadapt) from InfluenzaA__AHL91061__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucaaccccaacaacgaggagggcgggcacggggucaagggcugggccuucgacgacgggaacgacguguggaugggccgcaccaucucggagaagucccggcugggcuacgagaccuucaaggucaucgagggguggagcaaccacaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggcccgacggcgccgaccugaaccucaugccgaucuga

SEQ ID NO: 27074 - RNA, 1410 nt, Artificial Sequence
  derived and/or modified CDS sequence (AUadapt) from InfluenzaA__AHL91073__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaccuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacgcaggagagcgagugcgugugcaucaacgggaccugcaccguggucaugaccgacggcuccgccucgggcaaggccgacacgaagauccucuucaucgaggagggcaagaucgugcacaccagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccgggagccacugccucgaccccaacaacgaggagggcgggcacggcgucaaggggugggccuucgacgacggcaacgacguguggaugggccgcaccaucuccgagaagucccggcugggguacgagaccuucaaggucaucgagggcuggucgaaccacaagagcaagcugcagaucaaccgccaggugaucguggaccgggggaaccgcuccggcuacucggggaucuucuccgucgagggcaagagcugcaucaaccggugcuucuacguggagcucauccgcggccggaaggaggagaccgaggugcuguggaccucgaacuccaucgucguguucugcgggacgagcggcaccuacgggaccggcuccuggcccgacggggccgaccugaaccucaugccgaucuga

SEQ ID NO: 27075 - RNA, 1410 nt, Artificial Sequence
  derived and/or modified CDS sequence (AUadapt) from InfluenzaA__AHL91085__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccaagaucaucgagcgcaacaucacggagaucguguaccucaccaacaccaccaucgagaaggagaucugccccaagcuggccgaguaccggaacuggucgaagccgcagugcgacaucacgggguucgcgcccuucuccaaggacaacagcauccgccuguccgccggcggggacaucugggucacccgggagcccuacgugucgugcgaccccgacaagugcuaccaguucgcccucggccaggggaccacccugaacaacgugcacuccaacaacacgguccgcgaccggaccccguaccgcacccugcucaugaacgagcugggcgugcccuuccaccugggcaccaagcaggucugcaucgccuggagcuccucguccugccacgacgggaaggccuggcuccacgugugcaucacgggcgacgacaagaacgcgaccgccagcuucaucuacaacgggcggcugguggacuccguggucagcugguccaaggagauccugcgcacccaggagucggagugcgugugcaucaacggcaucugcaccguggucaugacggacggguccgccagcggcaaggccgacaccaagauccucuucaucgaggagggcaagaucgugcacaccucgacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggacguccaacagcaucgucguguucugcggcaccuccgggaccuacggcaccgggagcuggccggacggcgccgacaucaaccugaugcccaucuga

SEQ ID NO: 27076 - RNA, 1410 nt, Artificial Sequence; identical to SEQ ID NO: 19001
  derived and/or modified CDS sequence (AUadapt) from InfluenzaA__AHL91097__NA

SEQ ID NO: 27077 - RNA, 1410 nt, Artificial Sequence
  derived and/or modified CDS sequence (AUadapt) from InfluenzaA__AHL91109__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccacaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggcccgacggcgccgaccugaacaucaugccgaucuga

SEQ ID NO: 27078 - RNA, 1410 nt, Artificial Sequence; identical to SEQ ID NO: 20307
  derived and/or modified CDS sequence (AUadapt) from InfluenzaA__AHL91121__NA

SEQ ID NO: 27079 - RNA, 1410 nt, Artificial Sequence
  derived and/or modified CDS sequence (AUadapt) from InfluenzaA__AHL91133__NA
augaaccccaaccagaagaucaucaccaucggcucggugucccugaccaucagcacgaucugcuucuucaugcagaucgccauccucaucaccaccgucacccugcacuucaagcaguucgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccacaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggcccgacggcgccgaccugaaccucaugccgaucuga

SEQ ID NO: 27080 - RNA, 1410 nt, Artificial Sequence; identical to SEQ ID NO: 21706
  derived and/or modified CDS sequence (AUadapt) from InfluenzaA__AHL91145__NA

SEQ ID NO: 27081 - RNA, 1410 nt, Artificial Sequence; identical to SEQ ID NO: 21706
  derived and/or modified CDS sequence (AUadapt) from InfluenzaA__AHL91157__NA

SEQ ID NO: 27082 - RNA, 1410 nt, Artificial Sequence; identical to SEQ ID NO: 17114
  derived and/or modified CDS sequence (AUadapt) from InfluenzaA__AHL91169__NA

SEQ ID NO: 27083 - RNA, 1410 nt, Artificial Sequence; identical to SEQ ID NO: 16339
  derived and/or modified CDS sequence (AUadapt) from InfluenzaA__AHL94987__NA

SEQ ID NO: 27084 - RNA, 1410 nt, Artificial Sequence; identical to SEQ ID NO: 16339
  derived and/or modified CDS sequence (AUadapt) from InfluenzaA__AHL94999__NA

SEQ ID NO: 27085 - RNA, 1410 nt, Artificial Sequence
  derived and/or modified CDS sequence (AUadapt) from InfluenzaA__AHL95011__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggagcgcgcagcacguggaggagugcuccugcuacccccgguacccgggcguccgcugcgugugccgggacaacuggaaggggucgaaccgccccaucguggacaucaacaucaaggaccacuccaucgucagccgguacgugugcuccggccuggugggcgacaccccgcgcaagaacgacucguccagcuccucgcacugccuggaccccaacaacgaggagggcgggcacggggucaagggcugggccuucgacgacgggaacgacguguggaugggccggaccaucaacgagacgucccgccucggcuacgagaccuucaaggucaucgaggggugguucaaccccaagagcaagcugcagaucaaccgccaggugaucguggaccggggcgaccgguccggguacucgggcaucuucuccgucgagggcaagagcugcaucaaccgcugcuucuacguggagcugauccgggggcgcaaggaggagaccgaggugcucuggaccuccaacucgaucgucguguucugcggcacgagcgggaccuacggcaccggguccuggcccgacggcgccgaccugaaccugaugcccaucuga

SEQ ID NO: 27086 - RNA, 1410 nt, Artificial Sequence; identical to SEQ ID NO: 26305
  derived and/or modified CDS sequence (AUadapt) from InfluenzaA__AHL95023__NA

SEQ ID NO: 27087 - RNA, 1410 nt, Artificial Sequence; identical to SEQ ID NO: 16339
  derived and/or modified CDS sequence (AUadapt) from InfluenzaA__AHL95035__NA

SEQ ID NO: 27088 - RNA, 1410 nt, Artificial Sequence; identical to SEQ ID NO: 16339
  derived and/or modified CDS sequence (AUadapt) from InfluenzaA__AHL95047__NA

SEQ ID NO: 27089 - RNA, 1410 nt, Artificial Sequence; identical to SEQ ID NO: 26296
  derived and/or modified CDS sequence (AUadapt) from InfluenzaA__AHL95059__NA

SEQ ID NO: 27090 - RNA, 1410 nt, Artificial Sequence; identical to SEQ ID NO: 16339
  derived and/or modified CDS sequence (AUadapt) from InfluenzaA__AHL95071__NA

SEQ ID NO: 27091 - RNA, 1410 nt, Artificial Sequence; identical to SEQ ID NO: 16339
  derived and/or modified CDS sequence (AUadapt) from InfluenzaA__AHL95083__NA

SEQ ID NO: 27092 - RNA, 1410 nt, Artificial Sequence; identical to SEQ ID NO: 16339
  derived and/or modified CDS sequence (AUadapt) from InfluenzaA__AHL95095__NA

SEQ ID NO: 27093 - RNA, 1410 nt, Artificial Sequence; identical to SEQ ID NO: 16339
  derived and/or modified CDS sequence (AUadapt) from InfluenzaA__AHL95107__NA

SEQ ID NO: 27094 - RNA, 1410 nt, Artificial Sequence
  derived and/or modified CDS sequence (AUadapt) from InfluenzaA__AHL95119__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucucgugguccaaggagauccugcgcacccaggagagcgagugcgugugcaucaacggcacgugcaccguggucaugaccgacggguccgccucgggcaaggccgacaccaagauccuguucaucgaggagggcaagaucgugcacacgagcacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucgcgguacgugugcuccggccuggugggcgacaccccgcgcaagaacgacucgcuguccagcucccacugccucgaccccaacaacgaggagggcgggcacggggucaagggcugggccuucgacgacgggaacgacguguggaugggccggaccaucaacgagacgucgcgccugggcuacgagaccuucaaggucaucgaggggugguccaaccccaagagcaagcugcagaucaaccgccaggugaucguggaccggggcgaccgguccggguacucgggcaucuucuccgucgagggcaagagcugcaucaaccgcugcuucuacguggagcucauccgggggcgcaaggaggagaccgaggugcuguggaccuccaacucgaucgucguguucugcggcacgagcgggaccuacggcaccggguccuggcccgacggcgccgaccugaaccucaugcccaucuga

SEQ ID NO: 27095 - RNA, 1410 nt, Artificial Sequence; identical to SEQ ID NO: 25777
  derived and/or modified CDS sequence (AUadapt) from InfluenzaA__AHL95131__NA

SEQ ID NO: 27096 - RNA, 1410 nt, Artificial Sequence; identical to SEQ ID NO: 26285
  derived and/or modified CDS sequence (AUadapt) from InfluenzaA__AHL95143__NA

SEQ ID NO: 27097 - RNA, 1410 nt, Artificial Sequence
  derived and/or modified CDS sequence (AUadapt) from InfluenzaA__AHL95155__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcagcgcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacacgccccggaagaacgacuccagcuccucgucccacugccuggaccccaacaacgaggagggcagccacggggucaagggcugggccuucgacgacgggaacgacguguggaugggccgcaccaucaacgagaccucccggcucggcuacgagaccuucaaggucaucgagggguggucgaacccgaaguccaagcugcagaucaaccgccaggugaucguggaccggggcgaccgcagcggguacuccggcaucuucucggucgagggcaagagcugcaucaaccggugcuucuacguggagcugauccgcgggcggaaggaggagaccgaggugcucuggaccuccaacucgaucgucguguucugcggcacguccgggaccuacggcaccgggagcuggcccgacggcgccgaccugaaccugaugcccaucuga

SEQ ID NO: 27098 - RNA, 1410 nt, Artificial Sequence
  derived and/or modified CDS sequence (AUadapt) from InfluenzaA__AHL95167__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccucguccugccacgacgggaaggccuggcugcacgugugcaucaccggcgacgacaagaacgcgaccgccagcuucaucuacaacgggcggcucguggacuccguggucucgugguccaaggagauccugcgcacccaggagagcgagugcgugugcaucaacggcacgugcaccguggucaugaccgacggguccgccucgggcaaggccgacaccaagauccuguucaucgaggagggcaagaucgugcacacgagcacccucuccgggucggcgcagcacguggaggagugcuccugcuacccccgguacccgggcguccgcugcgugugccgggacaacuggaaggggucgaaccgccccaucguggacaucaacaucaaggaccacuccaucgucagccgguaccugugcuccggccuggugggcgacacgccccgcaagaacgacucguccagcuccucgcacugccucgaccccaacaacgaggagggcgggcacggggugaagggcugggccuucgacgacgggaacgacgucuggaugggccggaccaucaacgagaccucccgccugggcuacgagaccuucaaggugaucgagggguggucgaacccgaaguccaagcugcagaucaaccggcaggucaucguggaccgcggcgaccggagcggguacuccggcaucuucucgguggaggggaaguccugcaucaaccgcugcuucuacgucgagcucauccggggccgcaaggaggagaccgaggugcuguggaccagcaacucgaucguggucuucugcggcacguccgggaccuacggcaccgggagcuggcccgacggcgccgaccugaaccucaugcccaucuga

SEQ ID NO: 27099 - RNA, 1410 nt, Artificial Sequence; identical to SEQ ID NO: 16339
  derived and/or modified CDS sequence (AUadapt) from InfluenzaA__AHL95179__NA

SEQ ID NO: 27100 - RNA, 1410 nt, Artificial Sequence; identical to SEQ ID NO: 16339
  derived and/or modified CDS sequence (AUadapt) from InfluenzaA__AHL95191__NA

SEQ ID NO: 27101 - RNA, 1410 nt, Artificial Sequence; identical to SEQ ID NO: 16339
  derived and/or modified CDS sequence (AUadapt) from InfluenzaA__AHL95203__NA

SEQ ID NO: 27102 - RNA, 1410 nt, Artificial Sequence; identical to SEQ ID NO: 16339
  derived and/or modified CDS sequence (AUadapt) from InfluenzaA__AHL95215__NA

SEQ ID NO: 27103 - RNA, 1410 nt, Artificial Sequence
  derived and/or modified CDS sequence (AUadapt) from InfluenzaA__AHL95227__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacaugcacuccaacaacaccgugcgcgaccggacccccuaccgcacccugcugaugaacgagcucggcguccccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggugagcugguccaaggagauccugcgcacccaggagucggagugcgucugcaucaacgggacgugcaccguggugaugaccgacggcuccgccagcggcaaggccgacaccaagauccuguucaucgaggaggggaagaucguccacacgucgacccucuccggcucggcgcagcacguggaggagugcuccugcuacccccgguacccgggggugcgcugcgucugccgggacaacuggaagggcagcaaccgccccaucguggacaucaacaucaaggaccacuccaucgugucguccuacgucugcagcggccuggugggggacaccccgcgggagaacgacuccucguccagcucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggucaucguggaccgcggggaccgguccggcuacucggggaucuucuccguggagggcaagagcugcaucaaccggugcuucuacgucgagcugauccgcggccggaaggaggagaccgaggugcucuggaccucgaacuccaucguggucuucugcgggacgagcggcaccuacgggaccggcuccuggcccgacggggccgaccugaaccugaugcccaucuga

SEQ ID NO: 27104 - RNA, 1410 nt, Artificial Sequence; identical to SEQ ID NO: 26285
  derived and/or modified CDS sequence (AUadapt) from InfluenzaA__AHL95239__NA

SEQ ID NO: 27105 - RNA, 1410 nt, Artificial Sequence
  derived and/or modified CDS sequence (AUadapt) from InfluenzaA__AHL95251__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucaaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27106 - RNA, 1410 nt, Artificial Sequence; identical to SEQ ID NO: 16339
  derived and/or modified CDS sequence (AUadapt) from InfluenzaA__AHL95263__NA

SEQ ID NO: 27107 - RNA, 1410 nt, Artificial Sequence
  derived and/or modified CDS sequence (AUadapt) from InfluenzaA__AHL95275__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaucaccaucgagaaggagaucugccccaagccggccgaguaccggaacuggucgaagccccagugcgggaucacgggcuucgcgcccuucuccaaggacaacagcauccgccuguccgccgggggcgacaucugggucacccgggagcccuacgugucgugcgacccggacaagugcuaccaguucgcccuggggcagggcaccacccucaacaacgugcacuccaacaacacgguccgcgaccggacccccuaccgcacccugcugaugaacgagcucggcgugcccuuccaccuggggaccaagcaggucugcaucgccuggagcuccucguccugccacgacggcaaggccuggcugcacgugugcaucacgggggacgacaagaacgcgaccgccagcuucaucuacaacggccggcucguggacuccguggucucgugguccaaggagauccugcgcacccaggagagcgagugcgugugcaucaacgggaccugcacgguggucaugaccgacggcuccgccucgggcaaggccgacaccaagauccuguucaucgaggaggggaagaucgugcacaccagcacgcucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagaccucgcggcucggguacgagacguucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggaccagcggcacguacgggaccggcuccuggcccgacggggccgaccugaaccugaugcccaucuga

SEQ ID NO: 27108 - RNA, 1410 nt, Artificial Sequence; identical to SEQ ID NO: 25791
  derived and/or modified CDS sequence (AUadapt) from InfluenzaA__AHL95299__NA

SEQ ID NO: 27109 - RNA, 1410 nt, Artificial Sequence
  derived and/or modified CDS sequence (AUadapt) from InfluenzaA__AHL95310__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccucguccugccacgacgggaaggccuggcugcacgugugcaucaccggcgacgacaagaacgcgaccgccagcuucaucuacaacgggcggcucguggacuccguggucucgugguccaaggagauccugcgcacccaggagagcgagugcgugugcaucaacggcacgugcaccguggucaugaccgacggguccgccucgggcaaggccgacaccaagauccuguucaucgaggagggcaagaucgugcacacgagcacccucuccgggucggcgcagcacguggaggagugcuccugcuacccccgguacccgggcguccgcugcgugugccgggacaacuggaaggggucgaaccgccccaucguggacaucaacaucaaggaccacuccaucgucagccgguacgugugcuccggccuggugggcgacacgccccgcaagaacgacucguccagcuccucgcacugccuggaccccaacaacgaggagggcgggcacggggucaagggcugggccuucgacgacgggaacgacguguggaugggccggaccaucaacgagaccucccgccucggcuacgagaccuucaaggucaucgagggguggucgaacccgaaguccaagcugcagaucaaccgccaggugaucguggaccggggcgaccggagcggguacuccggcaucuucucggucgaggggaaguccugcaucaaccgcugcuucuacguggagcugauccggggccgcaaggaggagaccgaggugcucuggaccagcaacucgaucgucguguucugcggcacguccgggaccuacggcaccgggagcuggcccgacggcgccaaccugaaccugaugcccaucuga

SEQ ID NO: 27110 - RNA, 1410 nt, Artificial Sequence; identical to SEQ ID NO: 26296
  derived and/or modified CDS sequence (AUadapt) from InfluenzaA__AHL95322__NA

SEQ ID NO: 27111 - RNA, 1410 nt, Artificial Sequence; identical to SEQ ID NO: 16359
  derived and/or modified CDS sequence (AUadapt) from InfluenzaA__AHL95334__NA

SEQ ID NO: 27112 - RNA, 1410 nt, Artificial Sequence; identical to SEQ ID NO: 16339
  derived and/or modified CDS sequence (AUadapt) from InfluenzaA__AHL95423__NA

SEQ ID NO: 27113 - RNA, 1410 nt, Artificial Sequence; identical to SEQ ID NO: 26296
  derived and/or modified CDS sequence (AUadapt) from InfluenzaA__AHL95435__NA

SEQ ID NO: 27114 - RNA, 1410 nt, Artificial Sequence; identical to SEQ ID NO: 16359
  derived and/or modified CDS sequence (AUadapt) from InfluenzaA__AHL95447__NA

SEQ ID NO: 27115 - RNA, 1410 nt, Artificial Sequence
  derived and/or modified CDS sequence (AUadapt) from InfluenzaA__AHL95461__NA
augaaccccaaccagaagaucaucaccaucggcucggugucccugaccaucucgacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcccgccgaguaccggaacugguccaagccccagugcgggaucaccggcuucgcgcccuucagcaaggacaacuccauccgccugucggccgggggcgacaucugggucacccgggagccguacguguccugcgggcccgacaagugcuaccaguucgcccugggccagggcaccacgcucaacaacaugcacagcaacaacaccgugcgcgaccggacccccuaccgcacccugcugaugaacgagcucgggguccccuuccaccugggcacgaagcaggucugcaucgccugguccucguccucgugccacgacgggaaggccuggcugcacgugugcaucaccggcgacgacaagaacgcgaccgccuccuucaucuacaacgggcggcucguggacagcgugguguccuggucgaaggagauccugcgcacccaggaguccgagugcgucugcaucaacggcacgugcaccguggugaugaccgacggcagcgccuccgggaaggccgacaccaagauccuguucaucgaggagggcaagaucguccacacgucgacccucagcggguccgcgcagcacguggaggagugcucgugcuacccgcgguaccccggcgugcgcugcgucugccgggacaacuggaagggcuccaaccgccccaucguggacaucaacaucaaggaccacucgaucguguccagcuacgucugcuccgggcuggugggcgacacgccccggaagaacgacucguccagcuccucgcacugccuggacccgaacaacgaggagggcgggcacggggugaagggcugggccuucgacgacggcaacgacgucuggauggggcgcaccaucaacgagaccucccggcucggcuacgagaccuucaaggugaucgagggguggucgaaccccaaguccaagcugcagaucaaccgccaggucaucguggaccggggcgaccgcagcggguacuccggcaucuucucgguggagggcaaguccugcaucaaccggugcuucuacgucgagcugauccgcgggcggaaggaggagaccgaggugcucuggaccagcaacucgaucguggucuucugcggcacguccgggaccuacggcaccgggagcuggcccgacggcgccgaccugaaccugaugcccaucuga

SEQ ID NO: 27116 - RNA, 1410 nt, Artificial Sequence; identical to SEQ ID NO: 25324
  derived and/or modified CDS sequence (AUadapt) from InfluenzaA__AHL95473__NA

SEQ ID NO: 27117 - RNA, 1410 nt, Artificial Sequence; identical to SEQ ID NO: 16339
  derived and/or modified CDS sequence (AUadapt) from InfluenzaA__AHL95485__NA

SEQ ID NO: 27118 - RNA, 1410 nt, Artificial Sequence; identical to SEQ ID NO: 16339
  derived and/or modified CDS sequence (AUadapt) from InfluenzaA__AHL95497__NA

SEQ ID NO: 27119 - RNA, 1410 nt, Artificial Sequence
  derived and/or modified CDS sequence (AUadapt) from InfluenzaA__AHL95509__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaagaaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27120 - RNA, 1410 nt, Artificial Sequence; identical to SEQ ID NO: 16339
  derived and/or modified CDS sequence (AUadapt) from InfluenzaA__AHL95521__NA

SEQ ID NO: 27121 - RNA, 1410 nt, Artificial Sequence; identical to SEQ ID NO: 16339
  derived and/or modified CDS sequence (AUadapt) from InfluenzaA__AHL95533__NA

SEQ ID NO: 27122 - RNA, 1410 nt, Artificial Sequence; identical to SEQ ID NO: 16339
  derived and/or modified CDS sequence (AUadapt) from InfluenzaA__AHL95545__NA

SEQ ID NO: 27123 - RNA, 1410 nt, Artificial Sequence
  derived and/or modified CDS sequence (AUadapt) from InfluenzaA__AHL95557__NA
augaaccccaaccagaagaucaucaccaucggcucggugucccugaccaucucgacgaucugcuucuucauccagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccgcccgcgaccggacccccuaccgcacccugcugaugaacgagcucggcguccccuuccaccuggggacgaagcaggucugcaucgccuggucguccucguccugccacgacggcaaggcguggcugcacgugugcaucaccggggacgacaagaacgccaccgccagcuucaucuacaacggccggcucguggacuccguggugucgugguccaaggagauccugcgcacccaggagagcgagugcgucugcaucaacgggacgugcaccguggugaugaccgacggcuccgccucgggcaaggcggacaccaagauccuguucaucgaggaggggaagaucguccacacgagcacccucuccggcucggcccagcacguggaggagugcuccugcuacccccgguacccgggggugcgcugcgucugccgggacaacuggaagggcucgaaccgccccaucguggacaucaacaucaaggaccacuccaucgugagcuccuacgucugcucgggccuggugggggacacgccccggaagaacgacuccagcuccucgucccacugccuggaccccaacaacgaggagggcgggcacggcgugaaggggugggccuucgacgacggcaacgacgucuggaugggccgcaccaucaacgagaccucgcggcucggguacgagaccuucaaggugaucgagggcugguccaacccggagagcaagcugcagaucaaccgccaggucaucguggaccgcggggaccgguccggcuacucggggaucuucuccguggagggcaagagcugcaucaaccggugcuucuacgucgagcugauccgcggccggaaggaggagaccgaggugcucuggaccucgaacuccaucguggucuucugcgggacgagcggcaccuacgggaccggcuccuggcccgacggggccgaccugaaccugaugcccaucuga

SEQ ID NO: 27124 - RNA, 1410 nt, Artificial Sequence; identical to SEQ ID NO: 16359
  derived and/or modified CDS sequence (AUadapt) from InfluenzaA__AHL95569__NA

SEQ ID NO: 27125 - RNA, 1410 nt, Artificial Sequence; identical to SEQ ID NO: 16339
  derived and/or modified CDS sequence (AUadapt) from InfluenzaA__AHL95581__NA

SEQ ID NO: 27126 - RNA, 1410 nt, Artificial Sequence
  derived and/or modified CDS sequence (AUadapt) from InfluenzaA__AHL95605__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacacgccccggaagaacgacaucuccucguccagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggucgaacccgaaguccaagcugcagaucaaccgccaggugaucguggaccgcggggaccggagcggcuacuccgggaucuucucggucgagggcaaguccugcaucaaccggugcuucuacguggagcugauccgcggccggaaggaggagaccgaggugcucuggaccagcaacucgaucgucguguucugcgggacguccggcaccuacgggaccggcagcuggcccgacggggccgaccugaaccugaugcccaucuga

SEQ ID NO: 27127 - RNA, 1410 nt, Artificial Sequence; identical to SEQ ID NO: 16339
  derived and/or modified CDS sequence (AUadapt) from InfluenzaA__AHL95617__NA

SEQ ID NO: 27128 - RNA, 1410 nt, Artificial Sequence; identical to SEQ ID NO: 16339
  derived and/or modified CDS sequence (AUadapt) from InfluenzaA__AHL95629__NA

SEQ ID NO: 27129 - RNA, 1410 nt, Artificial Sequence; identical to SEQ ID NO: 16339
  derived and/or modified CDS sequence (AUadapt) from InfluenzaA__AHL95641__NA

SEQ ID NO: 27130 - RNA, 1410 nt, Artificial Sequence; identical to SEQ ID NO: 16339
  derived and/or modified CDS sequence (AUadapt) from InfluenzaA__AHL95653__NA

SEQ ID NO: 27131 - RNA, 1410 nt, Artificial Sequence; identical to SEQ ID NO: 27126
  derived and/or modified CDS sequence (AUadapt) from InfluenzaA__AHL95665__NA

SEQ ID NO: 27132 - RNA, 1410 nt, Artificial Sequence; identical to SEQ ID NO: 16339
  derived and/or modified CDS sequence (AUadapt) from InfluenzaA__AHL95677__NA

SEQ ID NO: 27133 - RNA, 1410 nt, Artificial Sequence
  derived and/or modified CDS sequence (AUadapt) from InfluenzaA__AHL95689__NA
augaaccccaaccagaagaucaucaccaucggcucggugucccugaccaucucgacgaucugcuucuucaugcagaucgccauccucaucaccaccgucacccugcacuucaagcaguacgaguucgacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccaaccugaaccugaugcccaucuga

SEQ ID NO: 27134 - RNA, 1410 nt, Artificial Sequence; identical to SEQ ID NO: 16339
  derived and/or modified CDS sequence (AUadapt) from InfluenzaA__AHL95701__NA

SEQ ID NO: 27135 - RNA, 1410 nt, Artificial Sequence; identical to SEQ ID NO: 16339
  derived and/or modified CDS sequence (AUadapt) from InfluenzaA__AHL95713__NA

SEQ ID NO: 27136 - RNA, 1410 nt, Artificial Sequence
  derived and/or modified CDS sequence (AUadapt) from InfluenzaA__AHL95725__NA
augaaccccaaccagaagaucaucaccaucggcucggugucccugaccaucucgacgaucugcuucuucaugcagaucgccauccucaucaccaccgucacccugcacuucaagcaguacgaguucgacccgccgcccaacaaccaggugaugcugugcgagcccacgaucaucgagcgcaacaucaccgagaucguguaccucaccaacaccacgaucgagaaggagaucugccccaagcccgccgaguaccggaacugguccaagccccagugcgggaucaccggcuucgcgcccuucagcaaggacaacuccauccgccugucggccgggggcgacaucugggucacccgggagccguacguguccugcgaccccgacaagugcuaccaguucgcccuggggcagggcaccacgcucaacaacgugcacagcaacaacaccguccgcgaccggacccccuaccgcacccugcugaugaacgagcucggcgugcccuuccaccuggggacgaagcaggucugcaucgccugguccucguccagcugccacgacggcaaggccuggcugcacgugugcaucaccggggacgacaagaacgcgaccgccuccuucaucuacaacggccggcucguggacucgguggucuccuggagcaaggagauccugcgcacccaggaguccgagugcgugugcaucaacgggacgugcaccguggucaugaccgacggcucggccuccggcaaggccgacaccaagauccuguucaucgaggaggggaagaucgugcacacgagcacccucucgggcuccgcgcagcacguggaggagugcucgugcuacccgcgguaccccgggguccgcugcgugugccgggacaacuggaagggcuccaaccgccccaucguggacaucaacaucaaggaccacagcaucgucuccucguacgugugcuccggccuggugggggacacgccccggaagaacgacagcuccucguccagccacugccuggacccgaacaacgaggagggcgggcacggcgucaaggggugggccuucgacgacggcaacgacguguggaugggccgcaccaucaacgagaccucccggcucggguacgagaccuucaaggucaucgagggcuggucgaaccccaaguccaagcugcagaucaaccgccaggugaucguggaccgcggggaccggagcggcuacuccgggaucuucucggucgagggcaaguccugcaucaaccggugcuucuacguggagcugauccgcggccggaaggaggagaucgaggugcucuggaccagcaacucgaucgucguguucugcgggaccuccggcacguacgggaccggcagcuggcccgacggggccgaccugaaccugaugcccaucuga

SEQ ID NO: 27137 - RNA, 1410 nt, Artificial Sequence; identical to SEQ ID NO: 26285
  derived and/or modified CDS sequence (AUadapt) from InfluenzaA__AHL95737__NA

SEQ ID NO: 27138 - RNA, 1410 nt, Artificial Sequence
  derived and/or modified CDS sequence (AUadapt) from InfluenzaA__AHL95749__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccgcccgcgaccggacccccuaccgcacccugcugaugaacgagcucggcguccccuuccaccuggggacgaagcaggucugcaucgccuggucguccucguccugccacgacggcaaggcguggcugcacgugugcaucaccggggacgacaagaacgccaccgccagcuucaucuacaacggccggcucguggacuccguggugucgugguccaaggagauccugcgcacccaggagagcgagugcgucugcaucaacgggacgugcaccguggugaugaccgacggcuccgccucgggcaaggcggacaccaagauccuguucaucgaggaggggaagaucguccacacgagcacccucuccggcucggcccagcacguggaggagugcuccugcuacccccgguacccgggggugcgcugcgucugccgggacaacuggaagggcucgaaccgccccaucguggacaucaacaucaaggaccacuccaucgugagcuccuacgucugcucgggccuggugggggacaccccgcggaagaacgacuccagcuccucgucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggucaucguggaccgcggggaccgguccggcuacucggggaucuucuccguggagggcaagagcugcaucaaccggugcuucuacgucgagcugauccgcggccggaaggaggagaccgaggugcucuggaccucgaacuccaucguggucuucugcgggacgagcggcaccuacgggaccggcuccuggcccgacggggccgaccugaaccugaugcccaucuga

SEQ ID NO: 27139 - RNA, 1410 nt, Artificial Sequence; identical to SEQ ID NO: 16339
  derived and/or modified CDS sequence (AUadapt) from InfluenzaA__AHL95761__NA

SEQ ID NO: 27140 - RNA, 1410 nt, Artificial Sequence; identical to SEQ ID NO: 16339
  derived and/or modified CDS sequence (AUadapt) from InfluenzaA__AHL95773__NA

SEQ ID NO: 27141 - RNA, 1410 nt, Artificial Sequence
  derived and/or modified CDS sequence (AUadapt) from InfluenzaA__AHL95785__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgguccgccuguccgccggcggggacaucugggugacccgggagcccuacgugagcugcgacccggacaagugcuaccaguucgcccugggccaggggaccacgcucaacaacguccacuccaacaacaccgugcgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccgucgugagcugguccaaggagauccugcgcacccaggagucggagugcgugugcaucaacggcacgugcaccgucgugaugaccgacggguccgccagcggcaaggccgacaccaagauccuguucaucgaggagggcaagaucgugcacacgucgacccucuccgggucggcgcagcacgucgaggagugcuccugcuacccccgguacccgggcgugcgcugcgugugccgggacaacuggaaggggagcaaccgccccaucgucgacaucaacaucaaggaccacuccaucgugucguccuacgugugcagcggccuggucggcgacaccccgcggaagaacgacuccucguccagcucccacugccuggaccccaacaacgaggagggcgggcacggggugaagggcugggccuucgacgacgggaacgacgucuggaugggccgcaccaucaacgagacgucgcggcucggcuacgagaccuucaaggugaucgaggggugguccaaccccaagagcaagcugcagaucaaccgccaggugaucgucgaccggggcgaccgcuccggguacucgggcaucuucuccguggagggcaagagcugcaucaaccggugcuucuacguggagcugauccgcgggcggaaggaggagaccgagguccucuggaccucgaacuccaucgugguguucugcggcacgagcgggaccuacggcaccggguccuggcccgacggcgccgaccugaaccugaugcccaucuga

SEQ ID NO: 27142 - RNA, 1410 nt, Artificial Sequence; identical to SEQ ID NO: 16359
  derived and/or modified CDS sequence (AUadapt) from InfluenzaA__AHL95797__NA

SEQ ID NO: 27143 - RNA, 1410 nt, Artificial Sequence; identical to SEQ ID NO: 16339
  derived and/or modified CDS sequence (AUadapt) from InfluenzaA__AHL95833__NA

SEQ ID NO: 27144 - RNA, 1410 nt, Artificial Sequence; identical to SEQ ID NO: 16359
  derived and/or modified CDS sequence (AUadapt) from InfluenzaA__AHL95845__NA

SEQ ID NO: 27145 - RNA, 1410 nt, Artificial Sequence
  derived and/or modified CDS sequence (AUadapt) from InfluenzaA__AHL95857__NA
augaaccccaaccagaagaucaucucgaucggcuccgugucgcugaccaucuccaccaucugcuucuucaugcagaucgccauccucaucacgaccgucacccugcacuucaagcaguacgaguucaacagcccgcccaacaaccaggugaugcugugcgagcccaccaucaucgagcgcaacaucacggagaucguguaccucaccaacaccaccaucgagaaggagaucugccccaagccggccgaguaccggaacugguccaagccccagugcgggaucacgggcuucgcgcccuucucgaaggacaacuccauccgccugagcgccgggggcgacaucugggucacccgggagcccuacguguccugcgacccggacaagugcuaccaguucgcccuggggcagggcaccacccucaacaacgugcacucgaacaacacgguccgcgaccggacccccuaccgcacccugcugaugaacgagcucggcgugcccuuccaccuggggaccaagcaggucugcaucgccugguccagcuccucgugccacgacggcaaggccuggcugcacgugugcaucacgggggacgacaagaacgcgaccgccuccuucaucuacaacggccggcucguggacagcguggucuccuggucgaaggagauccugcgcacccaggaguccgagugcgugugcaucaacgggaccugcacgguggucaugaccgacggcagcgccucgggcaaggccgacaccaagauccuguucaucgaggaggggaagaucgugcacaccuccacgcucagcggcuccgcgcagcacguggaggagugcucgugcuacccccgguacccggggguccgcugcgugugccgggacaacuggaagggcuccaaccgccccaucguggacaucaacaucaaggaccacagcaucgucuccucguacgugugcuccggccuggugggggacacgccccggaagaacgacagcuccucguccagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggucgaacccgaaguccaagcugcagaucaaccgccaggugaucguggaccgcggggaccggagcggcuacuccgggaucuucucggucgagggcaagagcugcaucaaccggugcuucuacguggagcugauccgcggccggaaggaggagaccgaggugcucuggaccuccaacucgaucgucguguucugcgggaccuccggcacguacgggaccggcagcuggcccgacggggccgaccugaaccugaugcccaucuga

SEQ ID NO: 27146 - RNA, 1410 nt, Artificial Sequence; identical to SEQ ID NO: 16339
  derived and/or modified CDS sequence (AUadapt) from InfluenzaA__AHL95869__NA

SEQ ID NO: 27147 - RNA, 1410 nt, Artificial Sequence
  derived and/or modified CDS sequence (AUadapt) from InfluenzaA__AHL95881__NA
augaaccccaaccagaagaucaucaccaucggcucggugugcaugaccaucgggauggccaaccugauccuccagaucggcaacaucaucuccaucuggaucagccacuccauccaggucgggaaccagagccagaucgagacgugcaaccaguccgugaucaccuacgagaacaacaccugggugaaccagaccuacgucaacaucagcaacacgaaccuggccgcgggccaguccguggugucggucaagcuggccgggaacuccagccucugcccgguguccggcugggccaucuacagcaaggacaacuccgugcgcaucggcagcaagggggacgucuucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgaggugcccagccccuacaacagccgguucgaguccgucgccuggagcgcguccgccugccacgacgggaucaacuggcucaccaucggcaucagcggccccgacuccggggccguggccgugcugaaguacaacggcaucaucaccgacaccaucaagucguggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucagcuucaaguacggcaacgggguguggaucggccgcaccaaguccaucagcucccggaagggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 27148 - RNA, 1410 nt, Artificial Sequence
  derived and/or modified CDS sequence (AUadapt) from InfluenzaA__AHL95892__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggagauccugcgcacccaggagagcgagugcgugugcaucaacgggacgugcaccguggucaugaccgacggcuccgccucgggcaaggccgacaccaagauccuguucaucgaggaggggaagaucgugcacacgagcacccucuccggcucggcgcagcacguggaggagugcuccugcuacccccgguacccggggguccgcugcgugugccgggacaacuggaagggcucgaaccgccccaucguggacaucaacaucaaggaccacuccaucgucagccgguacgugugcuccggccuggugggggacacgccccgcaagaacgacucguccagcuccucgcacugccuggaccccaacaacgaggagggcgggcacggcgucaaggggugggccuucgacgacggcaacgacguguggaugggccggaccaucaacgagaccucccgccucggguacgagaccuucaaggucaucgagggcuggucgaacccgaaguccaagcugcagaucaaccggcaggucaucguggaccgcggggaccggagcggcuacuccgggaucuucucgguggagggcaaguccugcaucaaccgcugcuucuacguggagcugauccggggccgcaaggaggagaccgaggugcucuggaccagcaacucgaucgucguguucugcgggacguccggcaccuacgggaccggcagcuggcccgacggggccgaccugaaccugaugcccaucuga

SEQ ID NO: 27149 - RNA, 1410 nt, Artificial Sequence; identical to SEQ ID NO: 16339
  derived and/or modified CDS sequence (AUadapt) from InfluenzaA__AHL95904__NA

SEQ ID NO: 27150 - RNA, 1410 nt, Artificial Sequence
  derived and/or modified CDS sequence (AUadapt) from InfluenzaA__AHL95916__NA
augaaccccaaccagaagaucaucaccaucggcucggugucccugaccaucucgacgaucugcuucuucaugcagaucgccauccucaucaccaccgucacccugcacuucaagcaguacgagcugaacuccccgcccaacaaccaggugaugcucugcgagcccacgaucaucgagcgcaacaucaccgagaucguguaccugaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccucgggcagggcaccacgcugaacaacgugcacuccaacaacaccguccgcgaccggacccccuaccgcacccugcucaugaacgagcugggcgugcccuuccaccuggggacgaagcaggucugcaucgccuggucguccucguccugccacgacggcaaggccuggcuccacgugugcaucaccggggacgacaagaacgcgaccgccagcuucaucuacaacggccggcugguggacuccguggucucgugguccaaggagauccugcgcacccaggagagcgagugcgugugcaucaacgggacgugcaccguggucaugaccgacggcuccgccucgggcaaggccgacaccaagauccucuucaucgaggaggggaagaucgugcacacgagcacccuguccggcucggcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacaccccgcggaagaacgacuccagcuccucgucccacugccucgaccccaacaacgaggagggcgggcacggcgucaaggggugggccuucgacgacggcaacgacguguggaugggccgcaccaucaacgagacgucgcggcugggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcucauccgcggccggaaggaggagaccgaggugcuguggaccucgaacuccaucgucguguucugcgggacgagcggcaccuacgggaccggcuccuggcccgacggggccgaccugaaccucaugcccaucuga

SEQ ID NO: 27151 - RNA, 1410 nt, Artificial Sequence; identical to SEQ ID NO: 26285
  derived and/or modified CDS sequence (AUadapt) from InfluenzaA__AHL95928__NA

SEQ ID NO: 27152 - RNA, 1410 nt, Artificial Sequence; identical to SEQ ID NO: 16359
  derived and/or modified CDS sequence (AUadapt) from InfluenzaA__AHL95940__NA

SEQ ID NO: 27153 - RNA, 1410 nt, Artificial Sequence; identical to SEQ ID NO: 16339
  derived and/or modified CDS sequence (AUadapt) from InfluenzaA__AHL95952__NA

SEQ ID NO: 27154 - RNA, 1410 nt, Artificial Sequence; identical to SEQ ID NO: 16339
  derived and/or modified CDS sequence (AUadapt) from InfluenzaA__AHL95964__NA

SEQ ID NO: 27155 - RNA, 1410 nt, Artificial Sequence; identical to SEQ ID NO: 16339
  derived and/or modified CDS sequence (AUadapt) from InfluenzaA__AHL95976__NA

SEQ ID NO: 27156 - RNA, 1410 nt, Artificial Sequence; identical to SEQ ID NO: 16339
  derived and/or modified CDS sequence (AUadapt) from InfluenzaA__AHL95988__NA

SEQ ID NO: 27157 - RNA, 1410 nt, Artificial Sequence; identical to SEQ ID NO: 16339
  derived and/or modified CDS sequence (AUadapt) from InfluenzaA__AHL96000__NA

SEQ ID NO: 27158 - RNA, 1410 nt, Artificial Sequence
  derived and/or modified CDS sequence (AUadapt) from InfluenzaA__AHL96012__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggucgaagccccagugcgggaucaccggcuucgcgcccuucuccaaggacaacagcauccgccuguccgccgggggcgacaucugggucacccgggugcccuacgugucgugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggagcuccucguccugccacgacggcaaggccuggcugcacgugugcaucaccggggacgacaagaacgcgaccgccagcuucaucuacaacggccggcucguggacuccgucgugucgugguccaaggagauccugcgcacccaggagagcgagugcgugugcaucaacgggacgugcaccgucgugaugaccgacggcuccgccucgggcaaggccgacaccaagauccuguucaucgaggaggggaagaucgugcacacgagcacccucuccggcucggcgcagcacgucgaggagugcuccugcuacccccgguacccgggggugcgcugcgugugccgggacaacuggaagggcagcaaccgccccaucgucgacaucaacaucaaggaccacuccaucgugucguccuacgugugcagcggccuggucggggacaccccgcggaagaacgacuccucguccagcucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggugaucgucgaccgcggggaccgguccggcuacucggggaucuucuccguggagggcaagagcugcaucaaccggugcuucuacguggagcugauccgcggccggaaggaggagaccgagguccucuggaccucgaacuccaucgugguguucugcgggacgagcggcaccuacgggaccggcuccuggcccgacggggccgaccugaaccugaugcccaucuga

SEQ ID NO: 27159 - RNA, 1410 nt, Artificial Sequence
  derived and/or modified CDS sequence (AUadapt) from InfluenzaA__AHL96024__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggagaaccugcgcacccaggagagcgagugcgugugcaucaacgggacgugcaccguggucaugaccgacggcuccgccucgggcaaggccgacaccaagauccuguucaucgaggaggggaagaucgugcacacgagcacccucuccggcucggcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacaccccgcggaagaacgacuccagcuccucgucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27160 - RNA, 1410 nt, Artificial Sequence; identical to SEQ ID NO: 16339
  derived and/or modified CDS sequence (AUadapt) from InfluenzaA__AHL96036__NA

SEQ ID NO: 27161 - RNA, 1410 nt, Artificial Sequence; identical to SEQ ID NO: 25791
  derived and/or modified CDS sequence (AUadapt) from InfluenzaA__AHL96048__NA

SEQ ID NO: 27162 - RNA, 1410 nt, Artificial Sequence; identical to SEQ ID NO: 16339
  derived and/or modified CDS sequence (AUadapt) from InfluenzaA__AHL96059__NA

SEQ ID NO: 27163 - RNA, 1410 nt, Artificial Sequence; identical to SEQ ID NO: 26285
  derived and/or modified CDS sequence (AUadapt) from InfluenzaA__AHL96071__NA

SEQ ID NO: 27164 - RNA, 1410 nt, Artificial Sequence; identical to SEQ ID NO: 27126
  derived and/or modified CDS sequence (AUadapt) from InfluenzaA__AHL96083__NA

SEQ ID NO: 27165 - RNA, 1410 nt, Artificial Sequence; identical to SEQ ID NO: 16339
  derived and/or modified CDS sequence (AUadapt) from InfluenzaA__AHL96095__NA

SEQ ID NO: 27166 - RNA, 1410 nt, Artificial Sequence
  derived and/or modified CDS sequence (AUadapt) from InfluenzaA__AHL96107__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacaugcacuccaacaacaccgugcgcgaccggacccccuaccgcacccugcugaugaacgagcucggcguccccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccguggugucgugguccaaggagauccugcgcacccaggagagcgagugcgucugcaucaacgggacgugcaccguggugaugaccgacggcuccgccucgggcaaggccgacaccaagauccuguucaucgaggaggggaagaucguccacacgagcacccucuccggcucggcgcagcacguggaggagugcuccugcuacccccgguacccgggggugcgcugcgucugccgggacaacuggaagggcucgaaccgccccaucguggacaucaacaucaaggaccacuccaucgugagcuccuacgucugcucgggccuggugggggacacgccccggaagaacgacaacuccagcuccucgcacugccuggaccccaacaacgaggagggcgggcacggcgugaaggggugggccuucgacgacggcaacgacgucuggaugggccgcaccaucaacgagaccucccggcucggguacgagaccuucaaggugaucgagggcuggucgaacccgaaguccaagcugcagaucaaccgccaggucaucguggaccgcggggaccggagcggcuacuccgggaucuucucgguggagggcaaguccugcaucaaccggugcuucuacgucgagcugauccgcggccggaaggaggagaccgaggugcucuggaccagcaacucgaucguggucuucugcgggacguccggcaccuacgggaccggcagcuggcccgacggggccgaccugaaccugaugcccaucuga

SEQ ID NO: 27167 - RNA, 1410 nt, Artificial Sequence; identical to SEQ ID NO: 16339
  derived and/or modified CDS sequence (AUadapt) from InfluenzaA__AHL96119__NA

SEQ ID NO: 27168 - RNA, 1410 nt, Artificial Sequence; identical to SEQ ID NO: 26285
  derived and/or modified CDS sequence (AUadapt) from InfluenzaA__AHL96131__NA

SEQ ID NO: 27169 - RNA, 1410 nt, Artificial Sequence; identical to SEQ ID NO: 16339
  derived and/or modified CDS sequence (AUadapt) from InfluenzaA__AHL96143__NA

SEQ ID NO: 27170 - RNA, 1410 nt, Artificial Sequence; identical to SEQ ID NO: 16339
  derived and/or modified CDS sequence (AUadapt) from InfluenzaA__AHL96167__NA

SEQ ID NO: 27171 - RNA, 1410 nt, Artificial Sequence; identical to SEQ ID NO: 16339
  derived and/or modified CDS sequence (AUadapt) from InfluenzaA__AHL96179__NA

SEQ ID NO: 27172 - RNA, 1410 nt, Artificial Sequence
  derived and/or modified CDS sequence (AUadapt) from InfluenzaA__AHL96191__NA
augaaccccaaccagaagaucaucaccaucggcucggugucccugaccaucucgacgaucugcuucuucaugcagaucgccauccucaucaccaccgucacccugcacuucaagcaguacgaguucgacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacaugcacuccaacaacaccgugcgcgaccggacccccuaccgcacccugcugaugaacgagcucggcguccccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggugagcugguccaaggagauccugcgcacccaggagucggagugcgucugcaucaacgggacgugcaccguggugaugaccgacggcuccgccagcggcaaggccgacaccaagauccuguucaucgaggaggggaagaucguccacacgucgacccucuccggcucggcgcagcacguggaggagugcuccugcuacccccgguacccgggggugcgcugcgucugccgggacaacuggaagggcagcaaccgccccaucguggacaucaacaucaaggaccacuccaucgugucguccuacgucugcagcggccuggugggggacaccccgcggaagaacgacuccucguccagcucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggucaucguggaccgcggggaccgguccggcuacucggggaucuucuccguggagggcaagagcugcaucaaccggugcuucuacgucgagcugauccgcggccggaaggaggagaccgaggugcucuggaccucgaacuccaucguggucuucugcgggacgagcggcaccuacgggaccggcuccuggcccgacggggccgaccugaaccugaugcccaucuga

SEQ ID NO: 27173 - RNA, 1410 nt, Artificial Sequence; identical to SEQ ID NO: 16359
  derived and/or modified CDS sequence (AUadapt) from InfluenzaA__AHL96203__NA

SEQ ID NO: 27174 - RNA, 1410 nt, Artificial Sequence; identical to SEQ ID NO: 26285
  derived and/or modified CDS sequence (AUadapt) from InfluenzaA__AHL96215__NA

SEQ ID NO: 27175 - RNA, 1410 nt, Artificial Sequence; identical to SEQ ID NO: 16339
  derived and/or modified CDS sequence (AUadapt) from InfluenzaA__AHL96227__NA

SEQ ID NO: 27176 - RNA, 1410 nt, Artificial Sequence; identical to SEQ ID NO: 16339
  derived and/or modified CDS sequence (AUadapt) from InfluenzaA__AHL96239__NA

SEQ ID NO: 27177 - RNA, 1410 nt, Artificial Sequence; identical to SEQ ID NO: 16339
  derived and/or modified CDS sequence (AUadapt) from InfluenzaA__AHL96251__NA

SEQ ID NO: 27178 - RNA, 1410 nt, Artificial Sequence; identical to SEQ ID NO: 16339
  derived and/or modified CDS sequence (AUadapt) from InfluenzaA__AHL96263__NA

SEQ ID NO: 27179 - RNA, 1410 nt, Artificial Sequence; identical to SEQ ID NO: 26329
  derived and/or modified CDS sequence (AUadapt) from InfluenzaA__AHL96277__NA

SEQ ID NO: 27180 - RNA, 1410 nt, Artificial Sequence
  derived and/or modified CDS sequence (AUadapt) from InfluenzaA__AHL96308__NA
augaaccccaaccagaagaucaucaccaucggcucggugucccugaccaucagcacgaucugcuucuucaugcagaucgccauccucaucaccaccgucacccugcacuucaagcaguacgaguucaacuucccgcccaacaaccaggugaugcugugcgagcccacgaucaucgagcgcaacaucaccgagaucguguaccucaccaacaccacgaucgagaaggagaucugccccaagccggccgaguaccggaacugguccaagccccagugcgggaucaccggcuucgcgcccuucucgaaggacaacuccauccgccugagcgccgggggcgacaucugggucacccgggagcccuacguguccugcgacccggacaagugcuaccaguucgcccuggggcagggcaccacgcucaacaacgugcacucgaacaacaccguccgcgaccggacccccuaccgcacccugcugauguccgagcucggcgugcccuuccaccuggggacgaagcaggucugcaucgccuggagcuccucguccugccacgacggcaaggccuggcugcacgugugcaucaccggggacgacaagaacgcgaccgccagcuucaucuacaacggccggcucguggacuccguggucucgugguccaaggagauccugcgcacccaggagagcgagugcgugugcaucaacgggacgugcaccguggucaugaccgacggcuccgccucgggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacaccccgcggaagaacgacuccagcuccucgucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagucgaagcugcagaucaaccgccaggugaucguggaccgcggggaccgguccggcuacagcgggaucuucuccgucgagggcaagucgugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 27181 - RNA, 1410 nt, Artificial Sequence; identical to SEQ ID NO: 25777
  derived and/or modified CDS sequence (AUadapt) from InfluenzaA__AHL96321__NA

SEQ ID NO: 27182 - RNA, 1410 nt, Artificial Sequence; identical to SEQ ID NO: 16339
  derived and/or modified CDS sequence (AUadapt) from InfluenzaA__AHL96333__NA

SEQ ID NO: 27183 - RNA, 1410 nt, Artificial Sequence
  derived and/or modified CDS sequence (AUadapt) from InfluenzaA__AHL96345__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggagauccugcgcacccaggagagcgagugcgugugcaucaacgggacgugcaccguggucaugaccgacggcuccgccucgggcaaggccgacaccaagauccuguucaucgaggaggggaagaucgugcacacgagcacccucuccggcucggcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacacgccccggaagaacgacaacuccagcuccucgcacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggucgaacccgaaguccaagcugcagaucaaccgccaggugaucguggaccgcggggaccggagcggcuacuccgggaucuucucggucgagggcaaguccugcaucaaccggugcuucuacguggagcugauccgcggccggaaggaggagaccgaggugcucuggaccagcaacucgaucgucguguucugcgggacguccggcaccuacgggaccggcagcuggcccgacggggccgaccugaaccugaugcccaucuga

SEQ ID NO: 27184 - RNA, 1410 nt, Artificial Sequence; identical to SEQ ID NO: 16359
  derived and/or modified CDS sequence (AUadapt) from InfluenzaA__AHL96357__NA

SEQ ID NO: 27185 - RNA, 1410 nt, Artificial Sequence; identical to SEQ ID NO: 16339
  derived and/or modified CDS sequence (AUadapt) from InfluenzaA__AHL96369__NA

SEQ ID NO: 27186 - RNA, 1410 nt, Artificial Sequence; identical to SEQ ID NO: 16339
  derived and/or modified CDS sequence (AUadapt) from InfluenzaA__AHL96381__NA

SEQ ID NO: 27187 - RNA, 1410 nt, Artificial Sequence; identical to SEQ ID NO: 26285
  derived and/or modified CDS sequence (AUadapt) from InfluenzaA__AHL96393__NA

SEQ ID NO: 27188 - RNA, 1410 nt, Artificial Sequence
  derived and/or modified CDS sequence (AUadapt) from InfluenzaA__AHL96405__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccugggccccaacaacgaggagggcgggcacggggucaagggcugggccuucgacgacggcaacgacguguggauggggcgcaccaucaacgagacgucgcggcucggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcccaucuga

SEQ ID NO: 27189 - RNA, 1410 nt, Artificial Sequence; identical to SEQ ID NO: 16339
  derived and/or modified CDS sequence (AUadapt) from InfluenzaA__AHL96417__NA

SEQ ID NO: 27190 - RNA, 1410 nt, Artificial Sequence; identical to SEQ ID NO: 16339
  derived and/or modified CDS sequence (AUadapt) from InfluenzaA__AHL96429__NA

SEQ ID NO: 27191 - RNA, 1410 nt, Artificial Sequence
  derived and/or modified CDS sequence (AUadapt) from InfluenzaA__AHL96441__NA
augaaccccaaccagaagaucaucaccaucggcucggugucccugaccaucucgacgaucugcuucuucaugcagaucgccauccucaucaccaccgucacccugcacuucaagcacuacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccucguccugccacgacgggaaggccuggcugcacgugugcaucaccggcgacgacaagaacgcgaccgccagcuucaucuacaacgggcggcucguggacuccguggucucgugguccaaggagauccugcgcacccaggagagcgagugcgugugcaucaacggcacgugcaccguggucaugaccgacggguccgccucgggcaaggccgacaccaagauccuguucaucgaggagggcaagaucgugcacacgagcacccucuccgggucggcgcagcacguggaggagugcuccugcuacccccgguacccgggcguccgcugcgugugccgggacaacuggaaggggucgaaccgccccaucguggacaucaacaucaaggaccacuccaucgucagccgguacgugugcuccggccuggugggcgacacgccccgcaagaacgacucguccagcuccucgcacugccugaaccccaacaacgaggagggcgggcacggggucaagggcugggccuucgacgacgggaacgacguguggaugggccggaccaucaacgagaccucccgccucggcuacgagaccuucaaggucaucgagggguggucgaacccgaaguccaagcugcagaucaaccggcagaucaucguggaccgcggcgaccggagcggguacuccggcaucuucucgguggaggggaaguccugcaucaaccgcugcuucuacgucgagcugauccggggccgcaaggaggagaccgaggugcucuggaccagcaacucgaucguggucuucugcggcacguccgggaccuacggcaccgggagcuggcccgacggcgccgaccugaaccugaugcccaucuga

SEQ ID NO: 27192 - RNA, 1410 nt, Artificial Sequence; identical to SEQ ID NO: 16339
  derived and/or modified CDS sequence (AUadapt) from InfluenzaA__AHL96453__NA

SEQ ID NO: 27193 - RNA, 1410 nt, Artificial Sequence; identical to SEQ ID NO: 16339
  derived and/or modified CDS sequence (AUadapt) from InfluenzaA__AHL96465__NA

SEQ ID NO: 27194 - RNA, 1410 nt, Artificial Sequence
  derived and/or modified CDS sequence (AUadapt) from InfluenzaA__AHL96477__NA
augaaccccaaccagaagaucaucaccaucggcucggugugcaugaccaucgggauggccaaccugauccuccagaucggcaacaucaucuccaucuggaucagccacuccauccaggucgggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccucgcugugcccgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacucgcgguucgaguccgucgccuggagcgcguccgccugccacgacgggaucaacuggcugaccaucggcaucagcggccccgacuccggggccguggccgugcucaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccuggaguaccagaucggguacaucugcuccggcaucuucggggacaacccgcggcccaacgacaagaccggcagcugcggccccguguccagcaacggggccaacggcgucaagggguucagcuucaaguacggcaacgggguguggaucggccgcaccaaguccaucucgucccggaagggcuucgagaugaucugggaccccaacggguggaccggcaccgacaacaacuucagcaucaagcaggacaucguggggaucaacgagugguccggcuacagcggguccuucguccagcacccggagcucacgggccuggacugcauccgccccugcuucuggguggagcugauccggggccgccccaaggagaacaccaucuggaccagcggguccagcaucuccuucugcggcgucaacagcgacaccguggggugguccuggcccgacggcgccgagcucccguucacgaucgacaaguga

SEQ ID NO: 27195 - RNA, 1410 nt, Artificial Sequence; identical to SEQ ID NO: 26285
  derived and/or modified CDS sequence (AUadapt) from InfluenzaA__AHL96488__NA

SEQ ID NO: 27196 - RNA, 1410 nt, Artificial Sequence; identical to SEQ ID NO: 16339
  derived and/or modified CDS sequence (AUadapt) from InfluenzaA__AHL96500__NA

SEQ ID NO: 27197 - RNA, 1410 nt, Artificial Sequence; identical to SEQ ID NO: 16339
  derived and/or modified CDS sequence (AUadapt) from InfluenzaA__AHL96512__NA

SEQ ID NO: 27198 - RNA, 1410 nt, Artificial Sequence; identical to SEQ ID NO: 25777
  derived and/or modified CDS sequence (AUadapt) from InfluenzaA__AHL96524__NA

SEQ ID NO: 27199 - RNA, 1410 nt, Artificial Sequence
  derived and/or modified CDS sequence (AUadapt) from InfluenzaA__AHL96536__NA
augaaccccaaccagaagaucaucaccaucggcucggugucccugaccaucucgacgaucugcuucuucacccagaucgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcacgaccaucaacaacgugcacuccaacaacaccguccgcgaccggacccccuaccgcacgcuccugaugaacgagcugggcgugcccuuccaccucgggaccaagcaggucugcaucgccuggucguccucguccugccacgacggcaaggccuggcugcacgugugcaucaccggggacgacaagaacgcgaccgccagcuucaucuacaacggccggcugguggacuccguggucucgugguccaaggagauccuccgcacgcaggagagcgagugcgugugcaucaacgggaccugcaccguggucaugaccgacggcuccgccucgggcaaggccgacacgaagauccuguucaucgaggaggggaagaucgugcacaccagcacccuguccggcucggcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccucgugggggacaccccgcggaagaacgacuccagcuccucgucccacugccuggaccccaacaacgaggagggcgggcacggcgucaaggggugggccuucgacgacggcaacgacguguggaugggccgcacgaucaacgagaccucgcggcugggguacgagaccuucaaggucaucgagggcugguccaaccccaagagcaagcuccagaucaaccgccaggugaucguggaccgcggggaccgguccggcuacucggggaucuucuccgucgagggcaagagcugcaucaaccggugcuucuacguggagcugauccgcggccggaaggaggagaccgaggugcuguggacgucgaacuccaucgucguguucugcgggaccagcggcaccuacgggaccggcuccuggcccgacggggccgaccucaaccugaugcccaucuga

SEQ ID NO: 27200 - RNA, 1410 nt, Artificial Sequence; identical to SEQ ID NO: 26285
  derived and/or modified CDS sequence (AUadapt) from InfluenzaA__AHL96548__NA

SEQ ID NO: 27201 - RNA, 1410 nt, Artificial Sequence
  derived and/or modified CDS sequence (AUadapt) from InfluenzaA__AHL96560__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggagauccugcgcacccaggagagcgagugcgugugcaucaacgggacgugcaccguggucaugaccgacggcaacgccuccggcaaggccgacaccaagauccuguucaucgaggaggggaagaucgugcacacgucgacccucagcggcuccgcgcagcacguggaggagugcucgugcuacccccgguacccggggguccgcugcgugugccgggacaacuggaagggcuccaaccgccccaucguggacaucaacaucaaggaccacucgaucgucuccagcuacgugugcuccggccuggugggggacacgccccggaagaacgacucguccagcuccucgcacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggucgaacccgaaguccaagcugcagaucaaccgccaggugaucguggaccgcggggaccggagcggcuacuccgggaucuucucggucgagggcaaguccugcaucaaccggugcuucuacguggagcugauccgcggccggaaggaggagaccgaggugcucuggaccagcaacucgaucgucguguucugcgggacguccggcaccuacgggaccggcagcuggcccgacggggccgaccugaaccugaugcccaucuga

SEQ ID NO: 27202 - RNA, 1410 nt, Artificial Sequence; identical to SEQ ID NO: 25759
  derived and/or modified CDS sequence (AUadapt) from InfluenzaA__AHL96572__NA

SEQ ID NO: 27203 - RNA, 1410 nt, Artificial Sequence; identical to SEQ ID NO: 27194
  derived and/or modified CDS sequence (AUadapt) from InfluenzaA__AHL96584__NA

SEQ ID NO: 27204 - RNA, 1410 nt, Artificial Sequence
  derived and/or modified CDS sequence (AUadapt) from InfluenzaA__AHL96595__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcagcgcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacaccccgcggaagaacgacuccagcuccucgucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagucgaagcugcagaucaaccgccaggugaucguggaccgcggggaccgguccggcuacagcgggaucuucuccgucgagucgaagagcugcaucaaccggugcuucuacguggagcugauccgcggccggaaggaggagaccgaggugcucuggaccuccaacucgaucgucguguucugcggcacguccgggaccuacggcaccgggagcuggcccgacggcgccgaccugaaccugaugcccaucuga

SEQ ID NO: 27205 - RNA, 1410 nt, Artificial Sequence; identical to SEQ ID NO: 16339
  derived and/or modified CDS sequence (AUadapt) from InfluenzaA__AHL96607__NA

SEQ ID NO: 27206 - RNA, 1410 nt, Artificial Sequence
  derived and/or modified CDS sequence (AUadapt) from InfluenzaA__AHL96631__NA
augaaccccaaccagaagaucaucaccaucggcucggugucccugaccaucagcacgaucugcuucuucaugcagaucgccauccucaucaccaccgucacccugcacuucaagcaguacgaguucaacucccugccgaacaaccaggugaugcucugcgagcccacgaucaucgagcgcaacaucaccgagaucguguaccugaccaacaccacgaucgagaaggagaucugccccaagcccgccgaguaccggaacuggucgaagccgcagugcgggaucaccggcuucgcgcccuucuccaaggacaacagcauccgccuguccgccgggggcgacaucugggucacccgggagcccuacgugucgugcgaccccgacaagugcuaccaguucgcccucgggcagggcaccacgcugaacaacaugcacuccaacaacaccgugcgcgaccggaccccguaccgcacccugcucaugaacgagcugggcguccccuuccaccuggggacgaagcaggucugcaucgccuggagcuccucguccugccacgacggcaaggccuggcuccacgugugcaucaccggggacgacaagaacgcgaccgccagcuucaucuacaacggccggcugguggacuccguggugucgugguccaaggagauccugcgcacccaggagagcgagugcgucugcaucaacgggacgugcaccguggugaugaccgacggcuccgccucgggcaaggccgacaccaagauccucuucaucgaggaggggaagaucguccacacgagcacccuguccggcucggcgcagcacguggaggagugcuccugcuacccccgguaccccggggugcgcugcgucugccgggacaacuggaagggcagcaaccgcccgaucguggacaucaacaucaaggaccacuccaucgugucguccuacgucugcagcggccuggugggggacacgccccggaagaacgacuccucguccagcucccacugccucgaccccaacaacgaggagggcgggcacggcgugaaggggugggccuucgacgacggcaacgacgucuggaugggccgcaccaucaacgagaccucgcggcugggguacgagaccuucaaggugaucgagggcugguccaaccccaagagcaagcugcagaucaaccgccaggucaucguggaccgcggggaccgguccggcuacucggggaucuucuccguggagggcaagagcugcaucaaccggugcuucuacgucgagcucauccgcggccggaaggaggagaccgaggugcuguggaccucgaacuccaucguggucuucugcgggacgagcggcaccuacgggaccggcuccuggccggacggggccgaccugaaccucaugcccaucuga

SEQ ID NO: 27207 - RNA, 1410 nt, Artificial Sequence; identical to SEQ ID NO: 26285
  derived and/or modified CDS sequence (AUadapt) from InfluenzaA__AHL96643__NA

SEQ ID NO: 27208 - RNA, 1410 nt, Artificial Sequence; identical to SEQ ID NO: 16339
  derived and/or modified CDS sequence (AUadapt) from InfluenzaA__AHL96655__NA

SEQ ID NO: 27209 - RNA, 1410 nt, Artificial Sequence; identical to SEQ ID NO: 16339
  derived and/or modified CDS sequence (AUadapt) from InfluenzaA__AHL96667__NA

SEQ ID NO: 27210 - RNA, 1410 nt, Artificial Sequence; identical to SEQ ID NO: 16339
  derived and/or modified CDS sequence (AUadapt) from InfluenzaA__AHL96679__NA

SEQ ID NO: 27211 - RNA, 1410 nt, Artificial Sequence; identical to SEQ ID NO: 16339
  derived and/or modified CDS sequence (AUadapt) from InfluenzaA__AHL96691__NA

SEQ ID NO: 27212 - RNA, 1410 nt, Artificial Sequence; identical to SEQ ID NO: 16339
  derived and/or modified CDS sequence (AUadapt) from InfluenzaA__AHL96703__NA

SEQ ID NO: 27213 - RNA, 1410 nt, Artificial Sequence; identical to SEQ ID NO: 16359
  derived and/or modified CDS sequence (AUadapt) from InfluenzaA__AHL96763__NA

SEQ ID NO: 27214 - RNA, 1410 nt, Artificial Sequence; identical to SEQ ID NO: 27126
  derived and/or modified CDS sequence (AUadapt) from InfluenzaA__AHL96787__NA

SEQ ID NO: 27215 - RNA, 1410 nt, Artificial Sequence
  derived and/or modified CDS sequence (AUadapt) from InfluenzaA__AHL96799__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggacgagaccgaggugcucuggaccucgaacuccaucgucguguucugcgggacgagcggcaccuacgggaccggcuccuggcccgacggggccgaccugaaccugaugcccaucuga

SEQ ID NO: 27216 - RNA, 1410 nt, Artificial Sequence; identical to SEQ ID NO: 26285
  derived and/or modified CDS sequence (AUadapt) from InfluenzaA__AHL96811__NA

SEQ ID NO: 27217 - RNA, 1410 nt, Artificial Sequence; identical to SEQ ID NO: 26285
  derived and/or modified CDS sequence (AUadapt) from InfluenzaA__AHL96823__NA

SEQ ID NO: 27218 - RNA, 1410 nt, Artificial Sequence; identical to SEQ ID NO: 16339
  derived and/or modified CDS sequence (AUadapt) from InfluenzaA__AHL96847__NA

SEQ ID NO: 27219 - RNA, 1410 nt, Artificial Sequence
  derived and/or modified CDS sequence (AUadapt) from InfluenzaA__AHL96859__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccagaugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggugacccgggagcccuacgucagcugcgacccggacaagugcuaccaguucgcccuggggcagggcaccacgcucaacaacgugcacuccaacaacaccgugcgcgaccggacccccuaccgcacccugcugaugaacgagcucggcguccccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggugagcugguccaaggagauccugcgcacccaggagucggagugcgucugcaucaacgggacgugcaccguggugaugaccgacggcuccgccagcggcaaggccgacaccaagauccuguucaucgaggaggggaagaucguccacacgucgacccucuccggcucggcgcagcacguggaggagugcuccugcuacccccgguacccgggggugcgcugcgucugccgggacaacuggaagggcagcaaccgccccaucguggacaucaacaucaaggaccacuccaucgugucguccuacgucugcagcggccuggugggggacaccccgcggaagaacgacuccucguccagcucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggucaucguggaccgcggggaccgguccggcuacucggggaucuucuccguggagggcaagagcugcaucaaccggugcuucuacgucgagcugauccgcggccggaaggaggagaccgaggugcucuggaccucgaacuccaucguggucuucugcgggacgagcggcaccuacgggaccggcuccuggcccgacggggccgaccugaaccugaugcccaucuga

SEQ ID NO: 27220 - RNA, 1410 nt, Artificial Sequence
  derived and/or modified CDS sequence (AUadapt) from InfluenzaA__AHL96871__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucguggagcgcaacaucaccgagaucgucuaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccgucgugucgugguccaaggaggugcugcgcacccaggagagcgagugcgucugcaucaacgggacgugcgccguggugaugaccgacggcuccgccucgggcaaggcggacaccaagauccuguucaucgaggaggggaagaucguccacaccagcacgcucuccggcucggcccagcacguggaggagugcuccugcuacccccgguacccgggggugcgcugcgucugccgggacaacuggaagggcucgaaccgccccaucguggacaucaacaucaaggaccacuccaucgugagcuccuacgucugcucgggccuggugggggacacgccccggaagaacgaccgcuccagcuccucgcacugccuggaccccaacaacgaggagggcgggcacggcgucaaggggugggccuucgacgacggcaacgacguguggaugggccggaccaucaacgagaccucccgccucggguacgagaccuucaaggugaucgagggcuggucgaacccgaaguccaagcugcagaucaaccggcaggucaucguggaccgcggggaccggagcggcuacuccgggaucuucucgguggagggcaaguccugcaucaaccgcugcuucuacgucgagcugauccggggccgcaaggaggagaccgaggugcucuggaccagcaacucgaucguggucuucugcgggaccuccggcacguacgggaccggcagcuggcccgacggggccgaccugaaccugaugcccaucuga

SEQ ID NO: 27221 - RNA, 1410 nt, Artificial Sequence
  derived and/or modified CDS sequence (AUadapt) from InfluenzaA__AHL96883__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagagcgccgaguaccggaacugguccaagccgcagugcgggaucaccggcuucgcgcccuucucgaaggacaacuccauccgccugagcgccgggggcgacaucugggucacccgggagcccuacguguccugcgaccccgacaagugcuaccaguucgcccuggggcagggcaccacgcucaacaacaugcacucgaacaacaccgugcgcgaccggaccccguaccgcacccugcugaugaacgagcucggcguccccuuccaccuggggacgaagcaggucugcaucgccugguccagcuccucgugccacgacggcaaggccuggcugcacgugugcaucaccggggacgacaagaacgcgaccgccuccuucaucuacaacggccggcucguggacagcgugguguccuggucgaaggagauccugcgcacccaggaguccgagugcgucugcaucaacgggacgugcaccguggugaugaccgacggcagcgccucgggcaaggccgacaccaagauccuguucaucgaggaggggaagaucguccacacguccacccucagcggcuccgcgcagcacguggaggagugcucgugcuacccccgguaccccggggugcgcugcgucugccgggacaacuggaagggcuccaaccgcccgaucguggacaucaacaucaaggaccacagcaucguguccucguacgucugcuccggccuggugggggacacgccccggaagaacgacagcuccucguccagccacugccuggaccccaacaacgaggagggcgggcacggcgugaaggggugggccuucgacgacggcaacgacgucuggaugggccgcaccaucaacgagaccucccggcucggguacgagaccuucaaggugaucgagggcuggucgaaccccaaguccaagcugcagaucaaccgccaggucaucguggaccgcggggaccggagcggcuacuccgggaucuucucgguggagggcaagagcugcaucaaccggugcuucuacgucgagcugauccgcggccggaaggaggagaccgaggugcucuggaccuccaacucgaucguggucuucugcgggacguccggcaccuacgggaccggcagcuggccggacggggccgaccugaaccugaugcccaucuga

SEQ ID NO: 27222 - RNA, 1410 nt, Artificial Sequence; identical to SEQ ID NO: 16359
  derived and/or modified CDS sequence (AUadapt) from InfluenzaA__AHL96895__NA

SEQ ID NO: 27223 - RNA, 1410 nt, Artificial Sequence
  derived and/or modified CDS sequence (AUadapt) from InfluenzaA__AHL96907__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucguggagcgcaacaucaccgagaucgucuaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccgucgugagcugguccaaggaggugcugcgcacccaggagucggagugcgucugcaucaacgggacgugcgccguggugaugaccgacggcuccgccagcggcaaggcggacaccaagauccuguucaucgaggaggggaagaucguccacaccucgacgcucuccggcucggcccagcacguggaggagugcuccugcuacccccgguacccgggggugcgcugcgucugccgggacaacuggaagggcagcaaccgccccaucguggacaucaacaucaaggaccacuccaucgugucguccuacgucugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagaccucgcggcucggguacgagacguucaaggugaucgagggcugguccaaccccaagagcaagcugcagaucaaccgccaggucaucguggaccgcggggaccgguccggcuacucggggaucuucuccguggagggcaagagcugcaucaaccggugcuucuacgucgagcugauccgcggccggaaggaggagaccgaggugcucuggaccucgaacuccaucguggucuucugcgggaccagcggcacguacgggaccggcuccuggcccgacggggccgaccugaaccugaugcccaucuga

SEQ ID NO: 27224 - RNA, 1410 nt, Artificial Sequence; identical to SEQ ID NO: 26285
  derived and/or modified CDS sequence (AUadapt) from InfluenzaA__AHL96919__NA

SEQ ID NO: 27225 - RNA, 1410 nt, Artificial Sequence; identical to SEQ ID NO: 26285
  derived and/or modified CDS sequence (AUadapt) from InfluenzaA__AHL96931__NA

SEQ ID NO: 27226 - RNA, 1410 nt, Artificial Sequence; identical to SEQ ID NO: 26285
  derived and/or modified CDS sequence (AUadapt) from InfluenzaA__AHL96943__NA

SEQ ID NO: 27227 - RNA, 1410 nt, Artificial Sequence
  derived and/or modified CDS sequence (AUadapt) from InfluenzaA__AHL96955__NA
augaaccccaaccagaagaucaucaccaucggcucggugucccugaccaucucgacgaucugcuucuucaugcagaucgccauccucaucaccaccgucacccugcacuucaagcaguacgaguucaacuccccgagcaacaaccaggugaugcugugcgagcccacgaucaucgagcgcaacaucaccgagaucguguaccucaccaacaccacgaucgagaaggagaucugccccaagcccgccgaguaccggaacugguccaagccgcagugcgggaucaccggcuucgcgcccuucucgaaggacaacuccauccgccugagcgccgggggcaacaucugggucacccgggagcccuacguguccugcgaccccgacaagugcuaccaguucgcccuggggcagggcaccacgcucaacaacgugcacucgaacaacaccguccgcgaccggaccccguaccgcacccugcugaugaacgagcucggcgugcccuuccaccuggggacgaagcaggucugcaucgccugguccagcuccucgugccacgacggcaaggccuggcugcacgugugcaucaccggggacgacaagaacgcgaccgccuccuucaucuacaacggccggcucguggacagcguggucuccuggucgaaggagauccugcgcacccaggaguccgagugcgugugcaucaacgggacgugcaccguggucaugaccgacggcagcgccucgggcaaggccgacaccaagauccuguucaucgaggaggggaagaucgugcacacguccacccucagcggcuccgcgcagcacguggaggagugcucgugcuacccccgguaccccgggguccgcugcgugugccgggacaacuggaagggcuccaaccgcccgaucguggacaucaacaucaaggaccacagcaucgucuccucguacgugugcuccggccuggugggggacacgccccggaagaacgacagcuccucguccagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggucgaaccccaaguccaagcugcagaucaaccgccaggugaucguggaccgcggggaccggagcggcuacuccgggaucuucucggucgagggcaagagcugcaucaaccggugcuucuacguggagcugauccgcggccggaaggaggagaccgaggugcucuggaccuccaacucgaucgucguguucugcgggacguccggcaccuacgggaccggcagcuggccggacggggccgaccugaaccugaugcccaucuga

SEQ ID NO: 27228 - RNA, 1410 nt, Artificial Sequence; identical to SEQ ID NO: 27126
  derived and/or modified CDS sequence (AUadapt) from InfluenzaA__AHL96967__NA

SEQ ID NO: 27229 - RNA, 1410 nt, Artificial Sequence
  derived and/or modified CDS sequence (AUadapt) from InfluenzaA__AHL96979__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacaugcacuccaacaacaccgugcgcgaccggacccccuaccgcacccugcugaugaacgagcucggcguccccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggugagcugguccaaggagauccugcgcacccaggagucggagugcgucugcaucaacggcacgugcaccguggugaugaccgacggguccgccagcggcaaggccgacaccaagauccuguucaucgaggagggcaagaucguccacacgucgacccucuccgggucggcgcagcacguggaggagugcuccugcuacccccgguacccgggcgugcgcugcgucugccgggacaacuggaaggggagcaaccgccccaucguggacaucaacaucaaggaccacuccaucgugucguccuacgucugcagcggccuggugggcgacaccccgcggaagaacgacuccucguccagcucccacugccuggaccccaacaacgaggagggcgggcacggggugaagggcugggccuucgacgacgggaacgacgucuggaugggccgcaccaucaacgagacgucgcggcucggcuacgagaccuucaaggugaucgaggggugguccaaccccaagagcaagcugcagaucaaccgccaggucaucguggaccggggcgaccgcuccggguacucgggcaucuucuccguggagggcaagagcugcaucaaccggugcuucuacgucgagcugauccgcgggcggaaggaggagaccgaggugcucuggaccucgaacuccaucguggucuucugcggcacgagcgggaccuacggcaccggguccuggcccgacggcgccgaccugaacaucaugcccaucuga

SEQ ID NO: 27230 - RNA, 1410 nt, Artificial Sequence; identical to SEQ ID NO: 26285
  derived and/or modified CDS sequence (AUadapt) from InfluenzaA__AHL96991__NA

SEQ ID NO: 27231 - RNA, 1410 nt, Artificial Sequence; identical to SEQ ID NO: 16339
  derived and/or modified CDS sequence (AUadapt) from InfluenzaA__AHL97003__NA

SEQ ID NO: 27232 - RNA, 1410 nt, Artificial Sequence
  derived and/or modified CDS sequence (AUadapt) from InfluenzaA__AHL97015__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccagaucaucguggaccgcggggaccgguccggcuacucggggaucuucuccguggagggcaagagcugcaucaaccggugcuucuacgucgagcugauccgcggccggaaggaggagaccgaggugcucuggaccucgaacuccaucguggucuucugcgggacgagcggcaccuacgggaccggcuccuggcccgacggggccgaccugaaccugaugcccaucuga

SEQ ID NO: 27233 - RNA, 1410 nt, Artificial Sequence; identical to SEQ ID NO: 16339
  derived and/or modified CDS sequence (AUadapt) from InfluenzaA__AHL97027__NA

SEQ ID NO: 27234 - RNA, 1410 nt, Artificial Sequence
  derived and/or modified CDS sequence (AUadapt) from InfluenzaA__AHL97039__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcaacgccuccggcaaggccgacaccaagauccuguucaucgaggaggggaagaucgugcacacgagcacccucucgggcuccgcgcagcacguggaggagugcucgugcuacccccgguacccggggguccgcugcgugugccgggacaacuggaagggcuccaaccgccccaucguggacaucaacaucaaggacuacagcaucgucuccucguacgugugcuccggccuggugggggacacgccccggaagaacgacagcuccucguccagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggucgaacccgaaguccaagcugcagaucaaccgccaggugaucguggaccgcggggaccggagcggcuacuccgggaucuucucggucgagggcaaguccugcaucaaccggugcuucuacguggagcugauccgcggccggaaggaggagaccgaggugcucuggaccagcaacucgaucgucguguucugcgggacguccggcaccuacgggaccggcagcuggcccgacggggccgaccugaaccugaugcccaucuga

SEQ ID NO: 27235 - RNA, 1410 nt, Artificial Sequence; identical to SEQ ID NO: 16339
  derived and/or modified CDS sequence (AUadapt) from InfluenzaA__AHL97051__NA

SEQ ID NO: 27236 - RNA, 1410 nt, Artificial Sequence
  derived and/or modified CDS sequence (AUadapt) from InfluenzaA__AHL97063__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccugggccccaacaacgaggagggcgggcacggggucaagggcugggccuucgacgacggcaacgacguguggauggggcgcaccaucaacgagacgucgcggcucggcuacgagaccuucaaggucaucgacgggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcccaucuga

SEQ ID NO: 27237 - RNA, 1410 nt, Artificial Sequence; identical to SEQ ID NO: 16339
  derived and/or modified CDS sequence (AUadapt) from InfluenzaA__AHL97075__NA

SEQ ID NO: 27238 - RNA, 1410 nt, Artificial Sequence; identical to SEQ ID NO: 16359
  derived and/or modified CDS sequence (AUadapt) from InfluenzaA__AHL97087__NA

SEQ ID NO: 27239 - RNA, 1410 nt, Artificial Sequence; identical to SEQ ID NO: 25777
  derived and/or modified CDS sequence (AUadapt) from InfluenzaA__AHL97099__NA

SEQ ID NO: 27240 - RNA, 1410 nt, Artificial Sequence; identical to SEQ ID NO: 16339
  derived and/or modified CDS sequence (AUadapt) from InfluenzaA__AHL97111__NA

SEQ ID NO: 27241 - RNA, 1410 nt, Artificial Sequence
  derived and/or modified CDS sequence (AUadapt) from InfluenzaA__AHL97123__NA
augaaccccaaccagaagaucaucaccaucggcucggugucccugaccaucucgacgaucugcuucuucaugcagaucgccauccucaucaccaccgucacccugcacuucaagcaguacgaguucgacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggcgcaacgacuccucguccagcucccacugccuggaccccaacaacgaggagggcgggcacggcgucaaggggugggccuucgacgacggcaacgacguguggaugggccggaccaucaacgagacgucgcgccucggguacgagaccuucaaggucaucgagggcugguccaaccccaagagcaagcugcagaucaaccggcaggucaucguggaccgcggggaccgguccggcuacucggggaucuucuccguggagggcaagagcugcaucaaccgcugcuucuacguggagcugauccggggccgcaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27242 - RNA, 1410 nt, Artificial Sequence; identical to SEQ ID NO: 26305
  derived and/or modified CDS sequence (AUadapt) from InfluenzaA__AHL97135__NA

SEQ ID NO: 27243 - RNA, 1410 nt, Artificial Sequence
  derived and/or modified CDS sequence (AUadapt) from InfluenzaA__AHL97147__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggcgcggcagcaaccggcccaucguggacaucaacaucaaggaccacuccaucgucucguccuacgugugcagcggccuggugggggacaccccgcgcaagaacgacuccucguccagcucccacugccuggaccccaacaacgaggagggcgggcacggcgucaaggggugggccuucgacgacggcaacgacguguggaugggccggaccaucaacgagacgucgcgccucggguacgagaccuucaaggucaucgagggcugguccaaccccaagagcaagcugcagaucaaccggcaggucaucguggaccgcggggaccgguccggcuacucggggaucuucuccguggagggcaagagcugcaucaaccgcugcuucuacguggagcugauccggggccgcaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27244 - RNA, 1410 nt, Artificial Sequence; identical to SEQ ID NO: 16339
  derived and/or modified CDS sequence (AUadapt) from InfluenzaA__AHL97159__NA

SEQ ID NO: 27245 - RNA, 1410 nt, Artificial Sequence; identical to SEQ ID NO: 16339
  derived and/or modified CDS sequence (AUadapt) from InfluenzaA__AHL97171__NA

SEQ ID NO: 27246 - RNA, 1410 nt, Artificial Sequence; identical to SEQ ID NO: 16339
  derived and/or modified CDS sequence (AUadapt) from InfluenzaA__AHL97183__NA

SEQ ID NO: 27247 - RNA, 1410 nt, Artificial Sequence; identical to SEQ ID NO: 16339
  derived and/or modified CDS sequence (AUadapt) from InfluenzaA__AHL97195__NA

SEQ ID NO: 27248 - RNA, 1410 nt, Artificial Sequence; identical to SEQ ID NO: 16339
  derived and/or modified CDS sequence (AUadapt) from InfluenzaA__AHL97207__NA

SEQ ID NO: 27249 - RNA, 1410 nt, Artificial Sequence; identical to SEQ ID NO: 16339
  derived and/or modified CDS sequence (AUadapt) from InfluenzaA__AHL97219__NA

SEQ ID NO: 27250 - RNA, 1410 nt, Artificial Sequence
  derived and/or modified CDS sequence (AUadapt) from InfluenzaA__AHL97231__NA
augaaccccaaccagaagaucaucaccaucggcucggugucccugaccaucucgacgaucugcuucuucaugcagaucgccauccucaucaccaccgucacccugcacuucaagcaguacgacuucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccgucaucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucggcgggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcccaucuga

SEQ ID NO: 27251 - RNA, 1410 nt, Artificial Sequence
  derived and/or modified CDS sequence (AUadapt) from InfluenzaA__AHL97243__NA
augaaccccaaccagaagaucaucaccaucggcucggugucccugaccaucucgacgaucugcuucuucaugcagaucgccauccucaucaccaccgucacccugaacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27252 - RNA, 1410 nt, Artificial Sequence; identical to SEQ ID NO: 25777
  derived and/or modified CDS sequence (AUadapt) from InfluenzaA__AHL97255__NA

SEQ ID NO: 27253 - RNA, 1410 nt, Artificial Sequence
  derived and/or modified CDS sequence (AUadapt) from InfluenzaA__AHL97267__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccgcccgcgaccggacccccuaccgcacccugcugaugaacgagcucggcguccccuuccaccuggggacgaagcaggucugcaucgccuggucguccagcuccugccacgacggcaaggcguggcugcacgugugcaucaccggggacgacaagaacgccaccgccucguucaucuacaacggccggcucguggacuccguggugagcugguccaaggagauccugcgcacccaggagucggagugcgucugcaucaacgggacgugcaccguggugaugaccgacggcuccgccagcggcaaggcggacaccaagauccuguucaucgaggaggggaagaucguccacacgucgacccucuccggcucggcccagcacguggaggagugcuccugcuacccccgguacccgggggugcgcugcgucugccgggacaacuggaagggcagcaaccgccccaucguggacaucaacaucaaggaccacuccaucgugucguccuacgucugcagcggccuggugggggacacgccccggaagaacgacuccuucucguccagccacugccuggaccccaacaacgaggagggcgggcacggcgugaaggggugggccuucgacgacggcaacgacgucuggaugggccgcaccaucaacgagaccucccggcucggguacgagaccuucaaggugaucgagggcuggucgaacccgaaguccaagcugcagaucaaccgccaggucaucguggaccgcggggaccggagcggcuacuccgggaucuucucgguggagggcaaguccugcaucaaccggugcuucuacgucgagcugauccgcggccggaaggaggagaccgaggugcucuggaccagcaacucgaucguggucuucugcgggacguccggcaccuacgggaccggcagcuggcccgacggggccgaccugaaccugaugcccaucuga

SEQ ID NO: 27254 - RNA, 1410 nt, Artificial Sequence; identical to SEQ ID NO: 16339
  derived and/or modified CDS sequence (AUadapt) from InfluenzaA__AHL97279__NA

SEQ ID NO: 27255 - RNA, 1410 nt, Artificial Sequence; identical to SEQ ID NO: 27138
  derived and/or modified CDS sequence (AUadapt) from InfluenzaA__AHL97291__NA

SEQ ID NO: 27256 - RNA, 1410 nt, Artificial Sequence; identical to SEQ ID NO: 27126
  derived and/or modified CDS sequence (AUadapt) from InfluenzaA__AHL97303__NA

SEQ ID NO: 27257 - RNA, 1410 nt, Artificial Sequence
  derived and/or modified CDS sequence (AUadapt) from InfluenzaA__AHL97339__NA
augaaccccaaccagaagaucaucaccaucggcucggugucccugaccaucucgacgaucugcuucuucaugcagaucgccauccucaucaccaccgucacccugcacuucaagcaguacgaguucgacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggaccucguaccgcacccugcugaugaacgagcucggcgugcccuuccaccuggggacgaagcaggucugcaucgccugguccagcuccucgugccacgacggcaaggccuggcugcacgugugcaucaccggggacgacaagaacgcgaccgccuccuucaucuacaacggccggcucguggacagcguggucuccuggucgaaggagauccugcgcacccaggaguccgagugcgugugcaucaacgggacgugcaccguggucaugaccgacggcagcgccucgggccgggccgacaccaagauccuguucaucgaggaggggaagaucgugcacacguccacccucagcggcuccgcgcagcacguggaggagugcucgugcuacccccgcuaccccgggguccggugcgugugccgcgacaacuggaagggcuccaaccggccgaucguggacaucaacaucaaggaccacagcaucgucuccucguacgugugcuccggccuggugggggacacgccccgcaagaacgacagcuccucguccagccacugccuggaccccaacaacgaggagggcgggcacggcgucaaggggugggccuucgacgacggcaacgacguguggaugggccggaccaucaacgagaccucccgccucggguacgagaccuucaaggucaucgagggcuggucgaaccccaaguccaagcugcagaucaaccggcaggucaucguggaccgcggggaccggagcggcuacuccgggaucuucucgguggagggcaagagcugcaucaaccgcugcuucuacguggagcugauccggggccgcaaggaggagaccgaggugcucuggaccuccaacucgaucgucguguucugcgggacguccggcaccuacgggaccggcagcuggccggacggggccgaccugaaccugaugcccaucuga

SEQ ID NO: 27258 - RNA, 1410 nt, Artificial Sequence; identical to SEQ ID NO: 16359
  derived and/or modified CDS sequence (AUadapt) from InfluenzaA__AHL97351__NA

SEQ ID NO: 27259 - RNA, 1410 nt, Artificial Sequence; identical to SEQ ID NO: 27138
  derived and/or modified CDS sequence (AUadapt) from InfluenzaA__AHL97363__NA

SEQ ID NO: 27260 - RNA, 1410 nt, Artificial Sequence; identical to SEQ ID NO: 16339
  derived and/or modified CDS sequence (AUadapt) from InfluenzaA__AHL97387__NA

SEQ ID NO: 27261 - RNA, 1410 nt, Artificial Sequence
  derived and/or modified CDS sequence (AUadapt) from InfluenzaA__AHL97399__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucauguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggugacccgggagcccuacgucagcugcgacccggacaagugcuaccaguucgcccuggggcagggcaccacgcucaacaacaugcacuccaacaacaccgugcgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccgucgugagcugguccaaggagauccugcgcacccaggagucggagugcgugugcaucaacgggacgugcaccgucgugaugaccgacggcuccgccagcggcaaggccgacaccaagauccuguucaucgaggaggggaagaucgugcacacgucgacccucuccggcucggcgcagcacgucgaggagugcuccugcuacccccgguacccgggggugcgcugcgugugccgggacaacuggaagggcagcaaccgccccaucgucgacaucaacaucaaggaccacuccaucgugucguccuacgugugcagcggccuggucggggacaccccgcggaagaacgacuccucguccagcucccacugccuggaccccaacaacgaggagggcgggcacggcgugaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucgucgaccgcggggaccgguccggcuacucggggaucuucuccguggagggccggagcugcaucaaccgcugcuucuacguggagcugauccggggccgcaaggaggagaccgagguccucuggaccucgaacuccaucgugguguucugcgggacgagcggcaccuacgggaccggcuccuggcccgacggggccgaccugaaccugaugcccaucuga

SEQ ID NO: 27262 - RNA, 1410 nt, Artificial Sequence; identical to SEQ ID NO: 25777
  derived and/or modified CDS sequence (AUadapt) from InfluenzaA__AHL97411__NA

SEQ ID NO: 27263 - RNA, 1410 nt, Artificial Sequence
  derived and/or modified CDS sequence (AUadapt) from InfluenzaA__AHL97423__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacauguggaugggccgcaccaucaacgagacgucgcggcucggguacgagaccuucaaggugaucgagggcugguccaaccccaagagcaagcugcagaucaaccgccaggucaucguggaccgcggggaccgguccggcuacucggggaucuucuccguggagggcaagagcugcaucaaccggugcuucuacgucgagcugauccgcggccggaaggaggagaccgaggugcucuggaccucgaacuccaucguggucuucugcgggacgagcggcaccuacgggaccggcuccuggcccgacggggccgaccugaaccugaugcccaucuga

SEQ ID NO: 27264 - RNA, 1410 nt, Artificial Sequence
  derived and/or modified CDS sequence (AUadapt) from InfluenzaA__AHL97447__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggucgaagccccagugcgggaucaccggcuucgcgcccuucuccaaggacaacagcauccgccuguccgccgggggcgacaucugggucacccgggagcccuacgugucgugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccucguccugccacgacggcaaggccuggcugcacgugugcaucaccggggacgacaagaacgcgaccgccagcuucaucuacaacggccggcucguggacuccguggucucgugguccaaggagauccugcgcacccaggagagcgagugcgugugcaucaacgggacgugcaccguggucaugaccgacggcuccgccucgggcaaggccgacaccaagauccuguucaucgaggaggggaagaucgugcacacgagcacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacacgccccggaagaacgacuccuucucguccagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggucgaacccgaaguccaagcugcagaucaaccgccaggugaucguggaccgcggggaccggagcggcuacuccgggaucuucucggucgagggcaaguccugcaucaaccggugcuucuacguggagcugauccgcggccggaaggaggagaccgaggugcucuggaccagcaacucgaucgucguguucugcgggacguccggcaccuacgggaccggcagcuggcccgacggggccgaccugaaccugaugcccaucuga

SEQ ID NO: 27265 - RNA, 1410 nt, Artificial Sequence; identical to SEQ ID NO: 16339
  derived and/or modified CDS sequence (AUadapt) from InfluenzaA__AHL97459__NA

SEQ ID NO: 27266 - RNA, 1410 nt, Artificial Sequence; identical to SEQ ID NO: 27138
  derived and/or modified CDS sequence (AUadapt) from InfluenzaA__AHL97471__NA

SEQ ID NO: 27267 - RNA, 1410 nt, Artificial Sequence; identical to SEQ ID NO: 16359
  derived and/or modified CDS sequence (AUadapt) from InfluenzaA__AHL97483__NA

SEQ ID NO: 27268 - RNA, 1410 nt, Artificial Sequence; identical to SEQ ID NO: 16339
  derived and/or modified CDS sequence (AUadapt) from InfluenzaA__AHL97496__NA

SEQ ID NO: 27269 - RNA, 1410 nt, Artificial Sequence; identical to SEQ ID NO: 16339
  derived and/or modified CDS sequence (AUadapt) from InfluenzaA__AHL97508__NA

SEQ ID NO: 27270 - RNA, 1410 nt, Artificial Sequence
  derived and/or modified CDS sequence (AUadapt) from InfluenzaA__AHL97520__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaccugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgggccggacaagugcuaccaguucgcccugggccagggcacgacccucaacaacaugcacuccaacaacaccgugcgcgaccggacccccuaccgcacgcugcugaugaacgagcucgggguccccuuccaccugggcaccaagcaggucugcaucgccuggucguccucguccugccacgacgggaaggccuggcugcacgugugcaucaccggcgacgacaagaacgcgaccgccagcuucaucuacaacgggcggcucguggacuccguggugucgugguccaaggagauccugcgcacgcaggagagcgagugcgucugcaucaacgggaccugcaccguggugaugaccgacggcuccgccucggggaaggccgacacgaagauccuguucaucgaggagggcaagaucguccacaccagcacccucuccgggucggcgcagcacguggaggagugcuccugcuacccccgguacccgggcgugcgcugcgucugccgggacaacuggaagggcucgaaccgccccaucguggacaucaacaucaaggaccacuccaucgugagcuccuacgucugcucggggcuggugggcgacaccccgcggaagaacgacuccagcuccucgucccacugccuggaccccaacaacgaggagggcggccacggggugaagggcugggccuucgacgacggcaacgacgucuggauggggcgcacgaucaacgagaccucgcggcucggcuacgagaccuucaaggugaucgaggggugguccaaccccaagagcaagcugcagaucaaccgccaggucaucguggaccggggcgaccgcuccggguacucgggcaucuucuccguggagggcaagagcugcaucaaccggugcuucuacgucgagcugauccgcgggcggaaggaggagaccgaggugcucuggacgucgaacuccaucguggucuucugcggcaccagcgggaccuacggcaccggguccuggcccgacggcgccgaccugaaccugaugcccaucuga

SEQ ID NO: 27271 - RNA, 1410 nt, Artificial Sequence; identical to SEQ ID NO: 16339
  derived and/or modified CDS sequence (AUadapt) from InfluenzaA__AHL97532__NA

SEQ ID NO: 27272 - RNA, 1410 nt, Artificial Sequence; identical to SEQ ID NO: 16339
  derived and/or modified CDS sequence (AUadapt) from InfluenzaA__AHL97544__NA

SEQ ID NO: 27273 - RNA, 1410 nt, Artificial Sequence; identical to SEQ ID NO: 16359
  derived and/or modified CDS sequence (AUadapt) from InfluenzaA__AHL97556__NA

SEQ ID NO: 27274 - RNA, 1410 nt, Artificial Sequence
  derived and/or modified CDS sequence (AUadapt) from InfluenzaA__AHL97568__NA
augaaccccaaccagaagaucaucaccaucggcucggugucccugaccaucucggccaucugcuucuucaugcagaucgccauccucaucacgaccgucacccugcgcuucaagcaguacgaguucaacuccccgcccaacaaccaggugaugcugugcgagcccaccaucaucgagcggaacaucacggagaucguguaccucaccaacaccaccaucgagaaggagaucugccccaagccggcggaguaccgcaacuggagcaagccccagugcgacaucacgggguucgcccccuucuccaaggacaacucgauccggcuguccgccggcggggacaucugggucacccgcgagcccuacgugagcugcgacccggacaagugcuaccaguucgcccugggccaggggaccacccucacgaacgugcacuccaacaacaccguccgggaccgcacccccuaccggacccugcugaugaacgagcucggcgugcccuuccaccugggcacgaagcaggucugcaucgccuggucguccucguccugccacgacgggaaggcguggcugcacgugugcaucaccggcgacgacaagaacgccaccgccagcuucaucuacaacgggcgccucguggacuccguggucucgugguccaaggagauccugcggacccaggagagcgagugcgugugcaucaacggcacgugcaccguggucaugaccgacggguccgccucgggcaaggcggacaccaagauccuguucaucgaggagggcaagaucgugcacacgagcacccucuccgggucggcccagcacguggaggagugcuccugcuacccccgcuacccgggcguccggugcgugugccgcgacaacuggaaggggucgaaccggcccaucguggacaucaacaucaaggaccacuccaucgucagccgcuacgugugcuccggccuggugggcgacacgccccggaagaacgacucguccagcuccucgcacugccuggaccccaacaacgaggagggcgggcacggggucaagggcugggccuucgacgacgggaacgacguguggaugggccgcaccaucaacgagaccucccggcucggcuacgagaccuucaaggucaucgagggguggucgaacccgaaguccaagcugcagaucaaccgccaggugaucguggaccggggcgaccgcagcggguacuccggcaucuucucggucgaggggaaguccugcaucaaccggugcuucuacguggagcugauccgcggccgcaaggaggagaccgaggugcucuggaccagcaacucgaucgucguguucugcggcacguccgggaccuacggcaccgggagcuggcccgacggcgccgaccugaaccugaugcccaucuga

SEQ ID NO: 27275 - RNA, 1410 nt, Artificial Sequence; identical to SEQ ID NO: 27188
  derived and/or modified CDS sequence (AUadapt) from InfluenzaA__AHL97580__NA

SEQ ID NO: 27276 - RNA, 1410 nt, Artificial Sequence
  derived and/or modified CDS sequence (AUadapt) from InfluenzaA__AHL97592__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgguccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccgucgugucgugguccaaggagauccugcgcacccaggagagcgagugcgugugcaucaacgggacgugcaccgucgugaugaccgacggcuccgccucgggcaaggccgacaccaagauccuguucaucgaggaggggaagaucgugcacacgagcacccucuccggcucggcgcagcacgucgaggagugcuccugcuacccccgguacccgggggugcgcugcgugugccgggacaacuggaagggcagcaaccgccccaucgucgacaucaacaucaaggaccacuccaucgugucguccuacgugugcagcggccuggucggggacacgccccggaagaacgacuccucguccucgucccacugccugggccccaacaacgaggagggcgggcacggggugaagggcugggccuucgacgacggcaacgacgucuggauggggcgcaccaucaacgagaccagccgguccggcuacgagaccuucaaggugaucgagggguggucgaacccgaaguccaagcuccagaucaaccgccaggugaucgucgaccggggcgaccgcagcggguacuccggcaucuucucgguggagggcaagagcugcaucaaccggugcuucuacguggagcugauccgcgggcggaaggaggagaccgagguccuguggaccuccaacucgaucgugguguucugcggcacguccgggaccuacggcaccgggagcuggcccgacggcgccgaccucaaccugaugcccaucuga

SEQ ID NO: 27277 - RNA, 1410 nt, Artificial Sequence; identical to SEQ ID NO: 16339
  derived and/or modified CDS sequence (AUadapt) from InfluenzaA__AHL97604__NA

SEQ ID NO: 27278 - RNA, 1410 nt, Artificial Sequence
  derived and/or modified CDS sequence (AUadapt) from InfluenzaA__AHL97616__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacaugcacuccaacaacaccgugcgcgaccggacccccuaccgcacccugcugaugaacgagcucggcguccccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggugagcugguccaaggagguccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27279 - RNA, 1410 nt, Artificial Sequence; identical to SEQ ID NO: 27138
  derived and/or modified CDS sequence (AUadapt) from InfluenzaA__AHL97628__NA

SEQ ID NO: 27280 - RNA, 1410 nt, Artificial Sequence; identical to SEQ ID NO: 16339
  derived and/or modified CDS sequence (AUadapt) from InfluenzaA__AHL97640__NA

SEQ ID NO: 27281 - RNA, 1410 nt, Artificial Sequence; identical to SEQ ID NO: 26296
  derived and/or modified CDS sequence (AUadapt) from InfluenzaA__AHL97652__NA

SEQ ID NO: 27282 - RNA, 1410 nt, Artificial Sequence; identical to SEQ ID NO: 26296
  derived and/or modified CDS sequence (AUadapt) from InfluenzaA__AHL97664__NA

SEQ ID NO: 27283 - RNA, 1410 nt, Artificial Sequence; identical to SEQ ID NO: 25777
  derived and/or modified CDS sequence (AUadapt) from InfluenzaA__AHL97676__NA

SEQ ID NO: 27284 - RNA, 1410 nt, Artificial Sequence; identical to SEQ ID NO: 16339
  derived and/or modified CDS sequence (AUadapt) from InfluenzaA__AHL97688__NA

SEQ ID NO: 27285 - RNA, 1410 nt, Artificial Sequence; identical to SEQ ID NO: 16359
  derived and/or modified CDS sequence (AUadapt) from InfluenzaA__AHL97700__NA

SEQ ID NO: 27286 - RNA, 1410 nt, Artificial Sequence
  derived and/or modified CDS sequence (AUadapt) from InfluenzaA__AHL97712__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggagauccugcgcacccaggagagcgagugcgugugcaucaacgggacgugcaccguggucaugaccgacggcuccgccucgggcaaggccgacaccaagauccuguucaucgaggaggggaagaucgugcacacgagcacccucuccggcucggcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacacgccccggaagaacgacuccaccagcuccucgcacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggucgaacccgaaguccaagcugcagaucaaccgccaggugaucguggaccgcggggaccggagcggcuacuccgggaucuucucggucgagggcaaguccugcaucaaccggugcuucuacguggagcugauccgcggccggaaggaggagaccgaggugcucuggacgagcaacucgaucgucguguucugcgggaccuccggcaccuacgggaccggcagcuggcccgacggggccgaccugaaccugaugcccaucuga

SEQ ID NO: 27287 - RNA, 1410 nt, Artificial Sequence; identical to SEQ ID NO: 16359
  derived and/or modified CDS sequence (AUadapt) from InfluenzaA__AHL97724__NA

SEQ ID NO: 27288 - RNA, 1410 nt, Artificial Sequence; identical to SEQ ID NO: 16339
  derived and/or modified CDS sequence (AUadapt) from InfluenzaA__AHL97736__NA

SEQ ID NO: 27289 - RNA, 1410 nt, Artificial Sequence
  derived and/or modified CDS sequence (AUadapt) from InfluenzaA__AHL97760__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacgagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27290 - RNA, 1410 nt, Artificial Sequence
  derived and/or modified CDS sequence (AUadapt) from InfluenzaA__AHL97772__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccgucgugguguucugcgggacgagcggcaccuacgggaccggcuccuggcccgacggggccgaccugaaccugaugcccaucuga

SEQ ID NO: 27291 - RNA, 1410 nt, Artificial Sequence; identical to SEQ ID NO: 25777
  derived and/or modified CDS sequence (AUadapt) from InfluenzaA__AHL97784__NA

SEQ ID NO: 27292 - RNA, 1410 nt, Artificial Sequence; identical to SEQ ID NO: 16339
  derived and/or modified CDS sequence (AUadapt) from InfluenzaA__AHL97796__NA

SEQ ID NO: 27293 - RNA, 1410 nt, Artificial Sequence; identical to SEQ ID NO: 16339
  derived and/or modified CDS sequence (AUadapt) from InfluenzaA__AHL97808__NA

SEQ ID NO: 27294 - RNA, 1410 nt, Artificial Sequence; identical to SEQ ID NO: 16339
  derived and/or modified CDS sequence (AUadapt) from InfluenzaA__AHL97820__NA

SEQ ID NO: 27295 - RNA, 1410 nt, Artificial Sequence
  derived and/or modified CDS sequence (AUadapt) from InfluenzaA__AHL97832__NA
augaaccccaaccagaagaucaucaccaucggcucggugucccugaccaucucgacgaucugcuucuucaugcagaucgccauccucaucaccaccgucacccugcacuucaagcaguacgaguucgacuccccgcccaacaaccaggugaugcugugcgagcccacgaucaucgagcgcaacaucaccgagaucguguaccucaccaacaccacgaucgagaaggagaucugccccaagccggccgaguaccggagcugguccaagccccagugcgggaucaccggcuucgcgcccuucucgaaggacaacuccauccgccugagcgccgggggcgacaucugggucacccgggagcccuacguguccugcgacccggacaagugcuaccaguucgcccuggggcagggcaccacgcucaacaacgugcacucgaacaacaccguccgcgaccggacccccuaccgcacccugcugaugaacgagcucggcgugcccuuccaccuggggacgaagcaggucugcaucgccugguccagcuccucgugccacgacggcaaggccuggcugcacgugugcaucaccggggacgacaagaacgcgaccgccuccuucaucuacaacggccggcucguggacagcguggucuccuggucgaaggagauccugcgcacccaggaguccgagugcgugugcaucaacgggacgugcaccguggucaugaccgacggcagcgccucgggcaaggccgacaccaagauccuguucaucgaggaggggaagaucgugcacacguccacccucagcggcuccgcgcagcacguggaggagugcucgugcuacccccgguacccggggguccgcugcgugugccgggacaacuggaagggcuccaaccgccccaucguggacaucaacaucaaggaccacagcaucgucuccucguacgugugcuccggccuggugggggacacgccccggaagaacgacagcuccucguccagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggucgaacccgaaguccaagcugcagaucaaccgccaggugaucguggaccgcggggaccggagcggcuacuccgggaucuucucggucgagggcaagagcugcaucaaccggugcuucuacguggagcugauccgcggccggaaggaggagaccgaggugcucuggaccuccaacucgaucgucguguucugcgggacguccggcaccuacgggaccggcagcuggcccgacggggccgaccugaaccugaugcccaucuga

SEQ ID NO: 27296 - RNA, 1410 nt, Artificial Sequence; identical to SEQ ID NO: 16339
  derived and/or modified CDS sequence (AUadapt) from InfluenzaA__AHL97844__NA

SEQ ID NO: 27297 - RNA, 1410 nt, Artificial Sequence; identical to SEQ ID NO: 27289
  derived and/or modified CDS sequence (AUadapt) from InfluenzaA__AHL97856__NA

SEQ ID NO: 27298 - RNA, 1410 nt, Artificial Sequence; identical to SEQ ID NO: 16339
  derived and/or modified CDS sequence (AUadapt) from InfluenzaA__AHL97868__NA

SEQ ID NO: 27299 - RNA, 1410 nt, Artificial Sequence; identical to SEQ ID NO: 16359
  derived and/or modified CDS sequence (AUadapt) from InfluenzaA__AHL97880__NA

SEQ ID NO: 27300 - RNA, 1410 nt, Artificial Sequence; identical to SEQ ID NO: 16339
  derived and/or modified CDS sequence (AUadapt) from InfluenzaA__AHL97892__NA

SEQ ID NO: 27301 - RNA, 1410 nt, Artificial Sequence; identical to SEQ ID NO: 16339
  derived and/or modified CDS sequence (AUadapt) from InfluenzaA__AHL97904__NA

SEQ ID NO: 27302 - RNA, 1410 nt, Artificial Sequence; identical to SEQ ID NO: 26285
  derived and/or modified CDS sequence (AUadapt) from InfluenzaA__AHL97916__NA

SEQ ID NO: 27303 - RNA, 1410 nt, Artificial Sequence; identical to SEQ ID NO: 16339
  derived and/or modified CDS sequence (AUadapt) from InfluenzaA__AHL97928__NA

SEQ ID NO: 27304 - RNA, 1410 nt, Artificial Sequence; identical to SEQ ID NO: 27264
  derived and/or modified CDS sequence (AUadapt) from InfluenzaA__AHL97952__NA

SEQ ID NO: 27305 - RNA, 1410 nt, Artificial Sequence; identical to SEQ ID NO: 16339
  derived and/or modified CDS sequence (AUadapt) from InfluenzaA__AHL97964__NA

SEQ ID NO: 27306 - RNA, 1410 nt, Artificial Sequence; identical to SEQ ID NO: 16339
  derived and/or modified CDS sequence (AUadapt) from InfluenzaA__AHL97976__NA

SEQ ID NO: 27307 - RNA, 1410 nt, Artificial Sequence; identical to SEQ ID NO: 16339
  derived and/or modified CDS sequence (AUadapt) from InfluenzaA__AHL97988__NA

SEQ ID NO: 27308 - RNA, 1410 nt, Artificial Sequence
  derived and/or modified CDS sequence (AUadapt) from InfluenzaA__AHL98000__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccacgagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaaggacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27309 - RNA, 1410 nt, Artificial Sequence
  derived and/or modified CDS sequence (AUadapt) from InfluenzaA__AHL98012__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggaggugcugcgcacccaggagucggagugcgugugcaucaacgggacgugcaccgucgugaugaccgacggcuccgccagcggcaaggccgacaccaagauccuguucaucgaggaggggaagaucgugcacacgucgacccucuccggcucggcgcagcacgucgaggagugcuccugcuacccccgguacccgggggugcgcugcgugugccgggacaacuggaagggcagcaaccgccccaucgucgacaucaacaucaaggaccacuccaucgugucguccuacgugugcagcggccuggucggggacaccccgcggaagaacgacuccucguccagcucccacugccuggaccccaacaacgaggagggcgaccacggggugaagggcugggccuucgacgacgggaacgacgucuggaugggccgcaccaucaacgagacgucgcggcucggcuacgagaccuucaaggugaucgaggggugguccaaccccaagagcaagcugcagaucaaccgccaggugaucgucgaccggggcgaccgcuccggguacucgggcaucuucuccguggagggcaagagcugcaucaaccggugcuucuacguggagcugauccgcgggcggaaggaggagaccgagguccucuggaccucgaacuccaucgugguguucugcggcacgagcgggaccuacggcaccggguccuggcccgacggcgccgaccugaaccugaugcccaucuga

SEQ ID NO: 27310 - RNA, 1410 nt, Artificial Sequence; identical to SEQ ID NO: 26285
  derived and/or modified CDS sequence (AUadapt) from InfluenzaA__AHL98048__NA

SEQ ID NO: 27311 - RNA, 1410 nt, Artificial Sequence; identical to SEQ ID NO: 26285
  derived and/or modified CDS sequence (AUadapt) from InfluenzaA__AHL98060__NA

SEQ ID NO: 27312 - RNA, 1410 nt, Artificial Sequence; identical to SEQ ID NO: 26285
  derived and/or modified CDS sequence (AUadapt) from InfluenzaA__AHL98072__NA

SEQ ID NO: 27313 - RNA, 1410 nt, Artificial Sequence; identical to SEQ ID NO: 16339
  derived and/or modified CDS sequence (AUadapt) from InfluenzaA__AHL98084__NA

SEQ ID NO: 27314 - RNA, 1410 nt, Artificial Sequence; identical to SEQ ID NO: 26285
  derived and/or modified CDS sequence (AUadapt) from InfluenzaA__AHL98096__NA

SEQ ID NO: 27315 - RNA, 1410 nt, Artificial Sequence; identical to SEQ ID NO: 16339
  derived and/or modified CDS sequence (AUadapt) from InfluenzaA__AHL98119__NA

SEQ ID NO: 27316 - RNA, 1410 nt, Artificial Sequence; identical to SEQ ID NO: 16339
  derived and/or modified CDS sequence (AUadapt) from InfluenzaA__AHL98131__NA

SEQ ID NO: 27317 - RNA, 1410 nt, Artificial Sequence; identical to SEQ ID NO: 16339
  derived and/or modified CDS sequence (AUadapt) from InfluenzaA__AHL98143__NA

SEQ ID NO: 27318 - RNA, 1410 nt, Artificial Sequence
  derived and/or modified CDS sequence (AUadapt) from InfluenzaA__AHL98155__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcagcgcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacacgccccggaagaacgacuccagcuccucgucccacugccuggaccccaacaacgaggagggcgggcacggcgucaaggggugggccuucgacgacggcaacgacguguggaugggccgcaccaucaacgagaccagccggcucggguacgagaccuucaaggucaucgagggcugguccaacucgaaguccaagcugcagaucaaccgccaggugaucguggaccgcggggaccggagcggcuacuccgggaucuucucggucgagggcaagagcugcaucaaccggugcuucuacguggagcugauccgcggccggaaggaggagaccgaggugcucuggaccuccaacucgaucgucguguucugcgggacguccggcaccuacgggaccggcagcuggccggacggggccgaccugaaccugaugcccaucuga

SEQ ID NO: 27319 - RNA, 1410 nt, Artificial Sequence; identical to SEQ ID NO: 16339
  derived and/or modified CDS sequence (AUadapt) from InfluenzaA__AHL98167__NA

SEQ ID NO: 27320 - RNA, 1410 nt, Artificial Sequence; identical to SEQ ID NO: 16339
  derived and/or modified CDS sequence (AUadapt) from InfluenzaA__AHL98179__NA

SEQ ID NO: 27321 - RNA, 1410 nt, Artificial Sequence; identical to SEQ ID NO: 16339
  derived and/or modified CDS sequence (AUadapt) from InfluenzaA__AHL98191__NA

SEQ ID NO: 27322 - RNA, 1410 nt, Artificial Sequence; identical to SEQ ID NO: 26285
  derived and/or modified CDS sequence (AUadapt) from InfluenzaA__AHL98215__NA

SEQ ID NO: 27323 - RNA, 1410 nt, Artificial Sequence
  derived and/or modified CDS sequence (AUadapt) from InfluenzaA__AHL98227__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgacaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacaugcacuccaacaacaccgugcgcgaccggacccccuaccgcacccugcugaugaacgagcucggcguccccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggugagcugguccaaggagauccugcgcacccaggagucggagugcgucugcaucaacgggacgugcaccguggugaugaccgacggcuccgccagcggcaaggccgacaccaagauccuguucaucgaggaggggaagaucguccacacgucgacccucuccggcucggcgcagcacguggaggagugcuccugcuacccccgguacccgggggugcgcugcgucugccgggacaacuggaagggcagcaaccgccccaucguggacaucaacaucaaggaccacuccaucgugucguccuacgucugcagcggccuggugggggacaccccgcggaagaacgacuccucguccagcucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggucaucguggaccgcggggaccgguccggcuacucggggaucuucuccguggagggcaagagcugcaucaaccggugcuucuacgucgagcugauccgcggccggaaggaggagaccgaggugcucuggaccucgaacuccaucguggucuucugcgggacgagcggcaccuacgggaccggcuccuggcccgacggggccgaccugaaccugaugcccaucuga

SEQ ID NO: 27324 - RNA, 1410 nt, Artificial Sequence; identical to SEQ ID NO: 16339
  derived and/or modified CDS sequence (AUadapt) from InfluenzaA__AHL98239__NA

SEQ ID NO: 27325 - RNA, 1410 nt, Artificial Sequence; identical to SEQ ID NO: 16339
  derived and/or modified CDS sequence (AUadapt) from InfluenzaA__AHL98251__NA

SEQ ID NO: 27326 - RNA, 1410 nt, Artificial Sequence; identical to SEQ ID NO: 26296
  derived and/or modified CDS sequence (AUadapt) from InfluenzaA__AHL98263__NA

SEQ ID NO: 27327 - RNA, 1410 nt, Artificial Sequence; identical to SEQ ID NO: 16339
  derived and/or modified CDS sequence (AUadapt) from InfluenzaA__AHL98275__NA

SEQ ID NO: 27328 - RNA, 1410 nt, Artificial Sequence; identical to SEQ ID NO: 27194
  derived and/or modified CDS sequence (AUadapt) from InfluenzaA__AHL98287__NA

SEQ ID NO: 27329 - RNA, 1410 nt, Artificial Sequence
  derived and/or modified CDS sequence (AUadapt) from InfluenzaA__AHL98298__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgggcgcaacaucaccgagaucguguaccucaccaacaccacgaucgagaaggagaucugccccaagccggccgaguaccggaacuggagcaagccccagugcggcaucaccggguucgcgcccuucuccaaggacaacucgauccgccuguccgccggcggggacaucugggucacccgggagcccuacgugagcugcgacccggacaagugcuaccaguucgcccugggccagggcaccacgcucaacaacgugcacuccaacaacaccguccgcgaccggacccccuaccgcacccugcugaugaacgagcucggggugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggcuccgccagcgggaaggccgacaccaagauccuguucaucgaggagggcaagaucgugcacacgucgacccucuccgggucggcgcagcacguggaggagugcuccugcuacccccgguacccgggcguccgcugcgugugccgggacaacuggaagggcagcaaccgccccaucguggacaucaacaucaaggaccacuccaucgucucguccuacgugugcagcgggcuggugggcgacaccccgcggaagaacgacuccucguccagcucccacugccuggaccccaacaacgaggagggcgggcacggggucaagggcugggccuucgacgacggcaacgacguguggauggggcgcaccaucaacgagacgucgcggcucggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcccaucuga

SEQ ID NO: 27330 - RNA, 1410 nt, Artificial Sequence; identical to SEQ ID NO: 16339
  derived and/or modified CDS sequence (AUadapt) from InfluenzaA__AHL98310__NA

SEQ ID NO: 27331 - RNA, 1410 nt, Artificial Sequence; identical to SEQ ID NO: 16339
  derived and/or modified CDS sequence (AUadapt) from InfluenzaA__AHL98322__NA

SEQ ID NO: 27332 - RNA, 1410 nt, Artificial Sequence
  derived and/or modified CDS sequence (AUadapt) from InfluenzaA__AHL98334__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagguggucuaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccgucgugagcugguccaaggagauccugcgcacccaggagucggagugcgugugcaucaacgggacgugcaccgucgugaugaccgacggcuccgccagcggcaaggccgacaccaagauccuguucaucgaggaggggaagaucgugcacacgucgacccucuccggcucggcgcagcacgucgaggagugcuccugcuacccccgguacccgggggugcgcugcgugugccgggacaacuggaagggcagcaaccgccccaucgucgacaucaacaucaaggaccacuccaucgugucguccuacgugugcagcggccuggucggggacaccccgcggaagaacgacuccucguccagcucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggugaucgucgaccgcggggaccgguccggcuacucggggaucuucuccguggagggcaagagcugcaucaaccggugcuucuacguggagcugauccgcggccggaaggaggagaccgagguccucuggaccucgaacuccaucgugguguucugcgggacgagcggcaccuacgggaccggcuccuggcccgacggggccgaccugaaccugaugcccaucuga

SEQ ID NO: 27333 - RNA, 1410 nt, Artificial Sequence
  derived and/or modified CDS sequence (AUadapt) from InfluenzaA__AHL98346__NA
augaaccccaaccagaagaucaucaccaucggcucggugucccugaccaucucgacgaucugcuucuucaugcagaucgccauccucaucaccaccgucacccugcacuucaagcaguacgaguucgacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaacgaggugcucuggaccucgaacuccaucgucguguucugcgggaccagcggcacguacgggaccggcuccuggcccgacggggccgaccugaaccugaugcccaucuga

SEQ ID NO: 27334 - RNA, 1410 nt, Artificial Sequence; identical to SEQ ID NO: 16339
  derived and/or modified CDS sequence (AUadapt) from InfluenzaA__AHL98357__NA

SEQ ID NO: 27335 - RNA, 1410 nt, Artificial Sequence; identical to SEQ ID NO: 26296
  derived and/or modified CDS sequence (AUadapt) from InfluenzaA__AHL98369__NA

SEQ ID NO: 27336 - RNA, 1410 nt, Artificial Sequence
  derived and/or modified CDS sequence (AUadapt) from InfluenzaA__AHL98381__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgggccggacaagugcuaccaguucgcccugggccagggcaccacgcucaacaacaugcacuccaacaacaccgugcgcgaccggacccccuaccgcacccugcugaugucggagcucgggguccccuuccaccugggcacgaagcaggucugcaucgccugguccagcuccucgugccacgacgggaaggccuggcugcacgugugcaucaccggcgacgacaagaacgcgaccgccuccuucaucuacaacgggcggcucguggacucggugguguccuggagcaaggagauccugcgcacccaggaguccgagugcgucugcaucaacggcacgugcaccguggugaugaccgacggcucggccagcgggaaggccgacaccaagauccuguucaucgaggagggcaagaucguccacacguccacccucucgggguccgcgcagcacguggaggagugcagcugcuacccccgguacccgggcgugcgcugcgucugccgggacaacuggaagggcuccaaccgccccaucguggacaucaacaucaaggaccacucgaccguguccagcuacgucugcuccgggcuggugggcgacacgccccggaagaacgacucguccucguccagccacugccuggaccccaacaacgaggagggcgggcacggggugaagggcugggccuucgacgacggcaacgacgucuggauggggcgcaccaucaacgagaccucccggcucggcuacgagaccuucaaggugaucgagggguggucgaacccgaaguccaagcugcagaucaaccgccaggucaucguggaccggggcgaccgcagcggguacuccggcaucuucucgguggagggcaagagcugcaucaaccggugcuucuacgucgagcugauccgcgggcggaaggaggagaccgaggugcucuggacguccaacucgaucguggucuucugcggcaccuccgggaccuacggcaccgggagcuggcccgacggcgccgaccugaaccugaugcccaucuga

SEQ ID NO: 27337 - RNA, 1410 nt, Artificial Sequence
  derived and/or modified CDS sequence (AUadapt) from InfluenzaA__AHL98393__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccagaugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggugacccgggagcccuacgucagcugcgggccggacaagugcuaccaguucgcccugggccagggcaccacgcucaacaacaugcacuccaacaacaccgugcgcgaccggacccccuaccgcacccugcugaugaacgagcucggggugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccgucgugagcugguccaaggagauccugcgcacccaggagucggagugcgugugcaucaacggcacgugcaccgucgugaugaccgacggcuccgccagcgggaaggccgacaccaagauccuguucaucgaggagggcaagaucgugcacacgucgacccucuccgggucggaccagcacaucgaggagugcuccugcuacccccgguacccgggcguccgcugcgugugccgggacaacuggaagggcagcaaccgccccaucguggacaucaacaucaaggaccacuccaucgucucguccuacgugugcagcgggcuggugggcgacaccccgcggaagaacgacuccucguccagcucccacugccuggaccccaacaacgaggagggcgggcacggggucaagggcugggcguucgacgacggcaacgacguguggauggggcgcaccaucaacgagacgucgcggcucggcuacgagaccuucaaggugaucgaggggugguccaaccccaagagcaagcugcagaucaaccgccaggucaucguggaccggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcccaucuga

SEQ ID NO: 27338 - RNA, 1410 nt, Artificial Sequence; identical to SEQ ID NO: 16339
  derived and/or modified CDS sequence (AUadapt) from InfluenzaA__AHL98405__NA

SEQ ID NO: 27339 - RNA, 1410 nt, Artificial Sequence; identical to SEQ ID NO: 16339
  derived and/or modified CDS sequence (AUadapt) from InfluenzaA__AHL98417__NA

SEQ ID NO: 27340 - RNA, 1410 nt, Artificial Sequence; identical to SEQ ID NO: 16339
  derived and/or modified CDS sequence (AUadapt) from InfluenzaA__AHL98429__NA

SEQ ID NO: 27341 - RNA, 1410 nt, Artificial Sequence
  derived and/or modified CDS sequence (AUadapt) from InfluenzaA__AHL98452__NA
augaaccccacccagaagaucaucaccaucggcucggugugcaugacgaucgggauggccaaccugauccuccagaucggcaacaucaucuccaucuggaucagccacuccauccagcuggggaaccagagccagaucgagaccugcaaccaguccgucaucaccuacgagaacaacaccugggugaaccagacguacgugaacaucagcaacaccaacuucgccgcgggccaguccgucgugagcgugaagcuggccgggaacuccucgcucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggacgaucaaggaccggagccccuaccgcacccugauguccugcccgaucggcgaggugcccagccccuacaacucgcgguucgaguccguggccuggagcgcguccgccugccacgacgggaucaacuggcucaccaucggcaucagcggccccgacuccggggccgucgccgugcugaaguacaacggcaucaucaccgacacgaucaagagcuggaagaacaacauccugcgcacccaggaguccgagugcgcgugcgugaacgggagcugcuucaccaucaugaccgacggcccguccgacggccaggccagcuacaagaucuuccggaucgagaaggggaagaucgucaaguccguggagaugaacgcccccaacuaccacuacgaggagugcucgugcuaccccgacuccagcgagaucacgugcgugugccgcgacaacuggcacggcuccaaccggcccugggucagcuucaaccagaaccucgaguaccagaucggguacaucugcuccggcguguucggggacaacccgcgccccaacgacaagaccggcagcugcggccccguguccagcaacggggccaacggcgucaagggguucagcuucaaguacggcaacgggguguggaucggccggaccaaguccaucucgucccgcaagggcuucgagaugaucugggaccccaacggguggaccggcacggacaacaacuucagcaucaagcaggacaucguggggaucaacgagugguccggcuacagcggguccuucguccagcacccggagcugaccggccuggacugcauccggcccugcuucuggguggagcucauccgcggccggcccaaggagaacaccaucuggaccagcggguccagcaucuccuucugcggcgucaacagcgacacgguggggugguccuggcccgacggcgccgagcugccguucaccaucgacaaguga

SEQ ID NO: 27342 - RNA, 1410 nt, Artificial Sequence
  derived and/or modified CDS sequence (AUadapt) from InfluenzaA__AHL98474__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacucgcgguucgaguccguggccuggagcgcguccgccugccacgacgggaucaacuggcucaccaucggcaucagcggccccaacuccggggccgucgccgugcugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcguguucggggacaacccgcggcccaacgacaagaccggcagcugcggccccguguccagcaacggggccaacggcgucaagggguucagcuucaaguacggcaacgggguguggaucggccgcaccaaguccaucucgucccggaagggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 27343 - RNA, 1410 nt, Artificial Sequence
  derived and/or modified CDS sequence (AUadapt) from InfluenzaA__AHL98485__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggucgaagccccagugcgggaucaccggcuucgcgcccuucuccaaggacaacagcauccgccuguccgccgggggcgacaucugggucacccgggagcccuacgugucgugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccucguccugccacgacggcaaggccuggcugcacgugugcaucaccggggacgacaagaacgcgaccgccagcuucaucuacaacggccggcucguggacuccguggucucgugguccaaggagauccugcgcacccaggagagcgagugcgugugcaucaacgggacgugcaccguggucaugaccgacggcuccgccucgggcaaggccgacaccaagauccuguucaucgaggaggggaagaucgugcacacgagcauccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagaccucgcggcucggguacgagacguucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggaccagcggcacguacgggaccggcuccuggcccgacggggccgaccugaaccugaugcccaucuga

SEQ ID NO: 27344 - RNA, 1410 nt, Artificial Sequence; identical to SEQ ID NO: 25777
  derived and/or modified CDS sequence (AUadapt) from InfluenzaA__AHL98497__NA

SEQ ID NO: 27345 - RNA, 1410 nt, Artificial Sequence; identical to SEQ ID NO: 16339
  derived and/or modified CDS sequence (AUadapt) from InfluenzaA__AHL98509__NA

SEQ ID NO: 27346 - RNA, 1410 nt, Artificial Sequence; identical to SEQ ID NO: 16339
  derived and/or modified CDS sequence (AUadapt) from InfluenzaA__AHL98521__NA

SEQ ID NO: 27347 - RNA, 1410 nt, Artificial Sequence; identical to SEQ ID NO: 25777
  derived and/or modified CDS sequence (AUadapt) from InfluenzaA__AHL98533__NA

SEQ ID NO: 27348 - RNA, 1410 nt, Artificial Sequence; identical to SEQ ID NO: 16339
  derived and/or modified CDS sequence (AUadapt) from InfluenzaA__AHL98545__NA

SEQ ID NO: 27349 - RNA, 1410 nt, Artificial Sequence; identical to SEQ ID NO: 16339
  derived and/or modified CDS sequence (AUadapt) from InfluenzaA__AHL98557__NA

SEQ ID NO: 27350 - RNA, 1410 nt, Artificial Sequence; identical to SEQ ID NO: 16339
  derived and/or modified CDS sequence (AUadapt) from InfluenzaA__AHL98569__NA

SEQ ID NO: 27351 - RNA, 1410 nt, Artificial Sequence
  derived and/or modified CDS sequence (AUadapt) from InfluenzaA__AHL98581__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcaacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27352 - RNA, 1410 nt, Artificial Sequence; identical to SEQ ID NO: 16339
  derived and/or modified CDS sequence (AUadapt) from InfluenzaA__AHL98593__NA

SEQ ID NO: 27353 - RNA, 1410 nt, Artificial Sequence; identical to SEQ ID NO: 26285
  derived and/or modified CDS sequence (AUadapt) from InfluenzaA__AHL98605__NA

SEQ ID NO: 27354 - RNA, 1410 nt, Artificial Sequence; identical to SEQ ID NO: 25777
  derived and/or modified CDS sequence (AUadapt) from InfluenzaA__AHL98617__NA

SEQ ID NO: 27355 - RNA, 1410 nt, Artificial Sequence; identical to SEQ ID NO: 25777
  derived and/or modified CDS sequence (AUadapt) from InfluenzaA__AHL98629__NA

SEQ ID NO: 27356 - RNA, 1410 nt, Artificial Sequence; identical to SEQ ID NO: 16339
  derived and/or modified CDS sequence (AUadapt) from InfluenzaA__AHL98641__NA

SEQ ID NO: 27357 - RNA, 1410 nt, Artificial Sequence; identical to SEQ ID NO: 27126
  derived and/or modified CDS sequence (AUadapt) from InfluenzaA__AHL98653__NA

SEQ ID NO: 27358 - RNA, 1410 nt, Artificial Sequence; identical to SEQ ID NO: 16339
  derived and/or modified CDS sequence (AUadapt) from InfluenzaA__AHL98665__NA

SEQ ID NO: 27359 - RNA, 1410 nt, Artificial Sequence
  derived and/or modified CDS sequence (AUadapt) from InfluenzaA__AHL98677__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugucgugcgacccggacaagugcuaccaguucgcccuggggcagggcaccacgcucaacaacgugcacuccaacaacaccguccgcgaccggacgccccaccgcacccugcugaugaacgagcucggcgugcccuuccaccuggggaccaagcaggucugcaucgccuggagcuccucguccugccacgacggcaaggccuggcugcacgugugcaucaccggggacgacaagaacgcgaccgccagcuucaucuacaacggccggcucguggacuccguggucucgugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcaacgcgcagcacguggaggagugcucgugcuacccccgguacccggggguccgcugcgugugccgggacaacuggaagggcuccaaccgccccaucguggacaucaacaucaaggaccacagcaucgucuccucguacgugugcuccggccuggugggggacacgccccggaagaacgacagcuccucguccucgcacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggagcaacccgaaguccaagcugcagaucaaccgccaggugaucguggaccgcggggaccggucgggcuacuccgggaucuucucggucgagggcaaguccugcaucaaccggugcuucuacguggagcugauccgcggccggaaggaggagaccgaggugcucuggaccagcaacucgaucgucguguucugcgggacguccggcaccuacgggaccggcagcuggcccgacggggccgaccugaaccugaugcccaucuga

SEQ ID NO: 27360 - RNA, 1410 nt, Artificial Sequence; identical to SEQ ID NO: 26296
  derived and/or modified CDS sequence (AUadapt) from InfluenzaA__AHL98689__NA

SEQ ID NO: 27361 - RNA, 1410 nt, Artificial Sequence
  derived and/or modified CDS sequence (AUadapt) from InfluenzaA__AHL98702__NA
augaaccccaaccagaagaucaucaccaucggcucggugucccugaccaucucgacgaucugcuucuucaugcagaucgccauccucaucaccaccgucacccugcacuucaagcaguacgaguucgacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacggccacuccaacaacaccgugcgcgaccggacccccuaccgcacccugcugaugaacgagcucgggguccccuuccaccugggcacgaagcaggucugcaucgccuggucguccucguccugccacgacgggaaggccuggcugcacgugugcaucaccggcgacgacaagaacgcgaccgccagcuucaucuacaacgggcggcucguggacuccguggugucgugguccaaggagauccugcgcacccaggagagcgagugcgucugcaucaacggcacgugcaccguggugaugaccgacggcuccgccucggggaaggccgacaccaagauccuguucaucgaggagggcaagaucguccacacgagcacccucuccgggucggcgcagcacguggaggagugcuccugcuacccccgguacccgggcgugcgcugcgucugccgggacaacuggaagggcucgaaccgccccaucguggacaucaacaucaaggaccacuccaucgugagcuccuacgucugcucggggcuggugggcgacaccccgcggaagaacgacuccagcuccucgucccacugccuggaccccaacaacgaggagggcgggcacggggugaagggcugggccuucgacgacggcaacgacgucuggauggggcgcaccaucaacgagacgucgcggcucggcuacgagaccuucaaggugaucgaggggugguccaaccccaagagcaagcugcagaucaaccgccaggucaucguggaccggggcgaccgcuccggguacucgggcaucuucuccguggagggcaagagcugcaucaaccggugcuucuacgucgagcugauccgcgggcggaaggaggagaccgaggugcucuggaccucgaacuccaucguggucuucugcggcacgagcgggaccuacggcaccggguccuggcccgacggcgccgaccugaaccugaugcccaucuga

SEQ ID NO: 27362 - RNA, 1410 nt, Artificial Sequence; identical to SEQ ID NO: 25791
  derived and/or modified CDS sequence (AUadapt) from InfluenzaA__AHL98714__NA

SEQ ID NO: 27363 - RNA, 1410 nt, Artificial Sequence
  derived and/or modified CDS sequence (AUadapt) from InfluenzaA__AHL98725__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgggaucugggucacccgggagcccuacgugagcugcgacccggacaagugcuaccaguucgcccugggccagggcaccacgcucaacaacgugcacuccaacaacaccguccgcgaccggacccccuaccgcacccugcugaugaacgagcucggggugcccuuccaccugggcacgaagcaggucugcaucgccuggucguccucguccugccacgacgggaaggccuggcugcacgugugcaucaccggcgacgacaagaacgcgaccgccagcuucaucuacaacgggcggcucguggacuccguggucucgugguccaaggagauccugcgcacccaggagagcgagugcgugugcaucaacggcacgugcaccguggucaugaccgacggcaacgccuccgggaaggccgacaccaagauccuguucaucgaggagggcaagaucgugcacacgucgacccucagcggguccgcgcagcacguggaggagugcucgugcuacccccgguacccgggcguccgcugcgugugccgggacaacuggaagggcuccaaccgccccaucguggacaucaacaucaaggaccacucgaucgucuccagcuacgugugcuccgggcuggugggcgacacgccccggaagaacgacucguccagcuccucgcacugccuggaccccaacaacgaggagggcgggcacggggucaagggcugggccuucgacgacgagaacgacguguggaugggccgcaccaucaacgagaccucccggcucggguacgagaccuucaaggucaucgagggcuggucgaacccgaaguccaagcugcagaucaaccgccaggugaucguggaccgggggaaccgcagcggcuacuccgggaucuucucggucgagggcaaguccugcaucaaccggugcuucuacguggagcugauccgcggccggaaggaggagaccgaggugcucuggaccagcaacucgaucgucguguucugcgggacguccggcaccuacgggaccggcagcuggcccgacggggccgaccugaaccugaugcccaucuga

SEQ ID NO: 27364 - RNA, 1410 nt, Artificial Sequence; identical to SEQ ID NO: 26285
  derived and/or modified CDS sequence (AUadapt) from InfluenzaA__AHL98737__NA

SEQ ID NO: 27365 - RNA, 1410 nt, Artificial Sequence; identical to SEQ ID NO: 16359
  derived and/or modified CDS sequence (AUadapt) from InfluenzaA__AHL98749__NA

SEQ ID NO: 27366 - RNA, 1410 nt, Artificial Sequence; identical to SEQ ID NO: 26285
  derived and/or modified CDS sequence (AUadapt) from InfluenzaA__AHL98761__NA

SEQ ID NO: 27367 - RNA, 1410 nt, Artificial Sequence
  derived and/or modified CDS sequence (AUadapt) from InfluenzaA__AHL98773__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcaacaucugggucacccgggagcccuacgugagcugcgacccggacaagugcuaccaguucgcccuggggcagggcaccacgcucaacaacgugcacuccaacaacaccgcccgcgaccggacccccuaccgcacccugcugaugaacgagcucggcguccccuuccaccuggggacgaagcaggucugcaucgccuggucguccucguccugccacgacggcaaggcguggcugcacgugugcaucaccggggacgacaagaacgccaccgccagcuucaucuacaacggccggcucguggacuccguggugucgugguccaaggagauccugcgcacccaggagagcgagugcgucugcaucaacgggacgugcaccguggugaugaccgacggcuccgccucgggcaaggcggacaccaagauccuguucaucgaggaggggaagaucguccacacgagcacccucuccggcucggcccagcacguggaggagugcuccugcuacccccgguacccgggggugcgcugcgucugccgggacaacuggaagggcucgaaccgccccaucguggacaucaacaucaaggaccacuccaucgugagcuccuacgucugcucgggccuggugggggacaccccgcggaagaacgacuccagcuccucgucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggucaucguggaccgcggggaccgguccggcuacucggggaucuucuccguggagggcaagagcugcaucaaccggugcuucuacgucgagcugauccgcggccggaaggaggagaccgaggugcucuggaccucgaacuccaucguggucuucugcgggacgagcggcaccuacgggaccggcuccuggcccgacggggccgaccugaaccugaugcccaucuga

SEQ ID NO: 27368 - RNA, 1410 nt, Artificial Sequence; identical to SEQ ID NO: 26305
  derived and/or modified CDS sequence (AUadapt) from InfluenzaA__AHL98785__NA

SEQ ID NO: 27369 - RNA, 1410 nt, Artificial Sequence
  derived and/or modified CDS sequence (AUadapt) from InfluenzaA__AHL98797__NA
augaaccccaaccagaagaucaucaccaucggcucggugucccugaccaucucgacgaucugcuucuucacccagaucgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcacgacccucaacaacgugcacuccaacaacaccguccgcgaccggacccccuaccgcacgcugcugaugaacgagcucggcgugcccuuccaccuggggaccaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggagauccugcgcacgcaggagagcgagugcgugugcaucaacgggaccugcaccguggucaugaccgacggcuccgccucgggcaaggccgacacgaagauccuguucaucgaggaggggaagaucgugcacaccucgacccucuccggcagcgcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacacgccccggaagaacgacuccucguccagcucccacugccuggaccccaacaacgaggagggcgggcacggcgucaaggggugggccuucgacgacggcaacgacguguggaugggccgcaccaucaacgagaccucgcgguccggguacgagaccuucaaggucaucgagggcuggagcaacccgaaguccaagcuccagaucaaccgccaggugaucguggaccgcggggaccggucgggcuacuccgggaucuucucggucgagggcaagagcugcaucaaccggugcuucuacguggagcugauccgcggccggaaggaggagaccgaggugcuguggacguccaacucgaucgucguguucugcgggaccuccggcaccuacgggaccggcagcuggcccgacggggccgaccucaaccugaugcccaucuga

SEQ ID NO: 27370 - RNA, 1410 nt, Artificial Sequence; identical to SEQ ID NO: 16339
  derived and/or modified CDS sequence (AUadapt) from InfluenzaA__AHL98809__NA

SEQ ID NO: 27371 - RNA, 1410 nt, Artificial Sequence
  derived and/or modified CDS sequence (AUadapt) from InfluenzaA__AHL98821__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggaccgcugcuaccaguucgcccuggggcagggcaccacgcucaacaacaugcacuccaacaacaccgugcgggaccgcacccccuaccggacccugcugaugaacgagcucggcguccccuuccaccuggggacgaagcaggucugcaucgccuggucguccagcuccugccacgacggcaaggccuggcugcacgugugcaucaccggggacgacaagaacgcgaccgccucguucaucuacaacggccgccucguggacuccguggugagcugguccaaggagauccugcggacccaggagucggagugcgucugcaucaacgggacgugcaccguggugaugaccgacggcuccgccagcggcaaggccgacaccaagauccuguucaucgaggaggggaagaucguccacacgucgacccucuccggcucggcgcagcacguggaggagugcuccugcuacccccgcuacccgggggugcggugcgucugccgcgacaacuggaagggcagcaaccggcccaucguggacaucaacaucaaggaccacuccaucgugucguccuacgucugcagcggccuggugggggacaccccgcgcaagaacgacuccucguccagcucccacugccuggaccccaacaacgaggagggcgggcacggcgugaaggggugggccuucgacgacggcaacgacgucuggaugggccggaccaucaacgagacgucgcgccucggguacgagaccuucaaggugaucgagggcugguccaaccccaagagcaagcugcagaucaaccggcaggucaucguggaccgcggggaccgguccggcuacucggggaucuucuccguggagggcaagagcugcaucaaccgcugcuucuacgucgagcugauccggggccgcaaggaggagaccgaggugcucuggaccucgaacuccaucguggucuucugcgggacgagcggcaccuacgggaccggcuccuggcccgacggggccgaccugaaccugaugcccaucuga

SEQ ID NO: 27372 - RNA, 1410 nt, Artificial Sequence; identical to SEQ ID NO: 16339
  derived and/or modified CDS sequence (AUadapt) from InfluenzaA__AHL98833__NA

SEQ ID NO: 27373 - RNA, 1410 nt, Artificial Sequence
  derived and/or modified CDS sequence (AUadapt) from InfluenzaA__AHL98845__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaucaacaccaccaucgagaaggagaucugccccaagccggccgaguaccggaacuggucgaagccccagugcgggaucacgggcuucgcgcccuucuccaaggacaacagcauccgccuguccgccgggggcgacaucugggucacccgggagcccuacgugucgugcgggccggacaagugcuaccaguucgcccugggccagggcaccacccucaacaacaugcacuccaacaacacggugcgcgaccggacccccuaccgcacccugcugaugaacgagcucgggguccccuuccaccugggcaccaagcaggucugcaucgccuggagcuccucguccugccacgacgggaaggccuggcugcacgugugcaucacgggcgacgacaagaacgcgaccgccagcuucaucuacaacgggcggcucguggacuccguggugucgugguccaaggagauccugcgcacccaggagagcgagugcgucugcaucaacgggaccugcacgguggugaugaccgacggcuccgccucggggaaggccgacaccaagauccuguucaucgaggagggcaagaucguccacaccagcacgcucuccgggucggcgcagcacguggaggagugcuccugcuacccccgguacccgggcgugcgcugcgucugccgggacaacuggaagggcagcaaccgccccaucguggacaucaacaucaaggaccacuccaucgugucguccuacgucugcagcgggcuggugggcgacaccccgcggaagaacgacuccucguccagcucccacugccuggaccccaacaacgaggagggcggccacggggugaagggcugggccuucgacgacggcaacgacgucuggauggggcgcaccaucaacgagaccucgcggcucggcuacgagacguucaaggugaucgaggggugguccaaccccaagagcaagcugcagaucaaccgccaggucaucguggaccggggcgaccgcuccggguacucgggcaucuucuccguggagggcaagagcugcaucaaccggugcuucuacgucgagcugauccgcgggcggaaggaggagaccgaggugcucuggaccucgaacuccaucguggucuucugcggcaccagcgggacguacggcaccggguccuggcccgacggcgccgaccugaaccugaugcccaucuga

SEQ ID NO: 27374 - RNA, 1410 nt, Artificial Sequence; identical to SEQ ID NO: 26285
  derived and/or modified CDS sequence (AUadapt) from InfluenzaA__AHL98857__NA

SEQ ID NO: 27375 - RNA, 1410 nt, Artificial Sequence; identical to SEQ ID NO: 26285
  derived and/or modified CDS sequence (AUadapt) from InfluenzaA__AHL98869__NA

SEQ ID NO: 27376 - RNA, 1410 nt, Artificial Sequence; identical to SEQ ID NO: 16339
  derived and/or modified CDS sequence (AUadapt) from InfluenzaA__AHL98881__NA

SEQ ID NO: 27377 - RNA, 1410 nt, Artificial Sequence
  derived and/or modified CDS sequence (AUadapt) from InfluenzaA__AHL98893__NA
augaaccccaaccagaagaucaucaccaucggcucggugucccugaccaucagcacgaucugcuucuucaugcagaucgccauccucaucaccaccgucacccugcacuucaagcaguacgaguucgacuccccgcccaacaaccaggugaugcugugcgagcccacgaucaucgagcgcaacaucaccgagaucguguaccucaccaacaccacgaucgagaaggagaucugccccaagccggccgaguaccggaacuggucgaagccccagugcgggaucaccggcuucgcgcccuucuccaaggacaacagcauccgccuguccgccgggggcgacaucugggucacccgggagcccuacgugucgugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccucguccugccacgacggcaaggccuggcugcacgugugcaucaccggggacgacaagaacgcgaccgccagcuucaucuacaacggccggcucguggacuccguggucucgugguccaaggagauccugcgcacccaggagagcgagugcgugugcaucaacgggacgugcaccguggucaugaccgacggcuccgccucgggcaaggccgacaccaagauccuguucaucgaggaggggaagaucgugcacacgagcacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucuucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27378 - RNA, 1410 nt, Artificial Sequence; identical to SEQ ID NO: 16359
  derived and/or modified CDS sequence (AUadapt) from InfluenzaA__AHL98905__NA

SEQ ID NO: 27379 - RNA, 1410 nt, Artificial Sequence; identical to SEQ ID NO: 16339
  derived and/or modified CDS sequence (AUadapt) from InfluenzaA__AHL98916__NA

SEQ ID NO: 27380 - RNA, 1410 nt, Artificial Sequence; identical to SEQ ID NO: 26296
  derived and/or modified CDS sequence (AUadapt) from InfluenzaA__AHL98928__NA

SEQ ID NO: 27381 - RNA, 1410 nt, Artificial Sequence; identical to SEQ ID NO: 16339
  derived and/or modified CDS sequence (AUadapt) from InfluenzaA__AHL98940__NA

SEQ ID NO: 27382 - RNA, 1410 nt, Artificial Sequence; identical to SEQ ID NO: 16339
  derived and/or modified CDS sequence (AUadapt) from InfluenzaA__AHL98952__NA

SEQ ID NO: 27383 - RNA, 1410 nt, Artificial Sequence; identical to SEQ ID NO: 16359
  derived and/or modified CDS sequence (AUadapt) from InfluenzaA__AHL98964__NA

SEQ ID NO: 27384 - RNA, 1410 nt, Artificial Sequence
  derived and/or modified CDS sequence (AUadapt) from InfluenzaA__AHL98976__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucguggagcgcaacaucaccgagaucgucuaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccgucgccucgugguccaaggaggugcugcgcacccaggagagcgagugcgugugcaucaacgggacgugcgccgucgugaugaccgacggcuccgcgucgggcaaggccgacaccaagauccuguucaucgaggaggggaagaucgugcacaccagcacgcucuccggcucggcccagcacgucgaggagugcuccugcuacccccgguacccgggggugcgcugcgugugccgggacaacuggaagggcucgaaccgccccaucgucgacaucaacaucaaggaccacuccaucgugagcuccuacgugugcucgggccuggucggggacaccccgcggaagaacgacuccagcuccucgucccacugccuggaccccaacaacgaggagggcgggcacggcgugaaggggugggccuucgacgacggcaacgacgucuggaugggccgcaccaucaacgagaccucgcggcucggguacgagacguucaaggugaucgagggcugguccaaccccaagagcaagcugcagaucaaccgccaggugaucgucgaccgcggggaccgguccggcuacucggggaucuucuccguggagggcaagagcugcaucaaccggugcuucuacguggagcugauccgcggccggaaggaggagaccgagguccucuggaccucgaacuccaucgugguguucugcgggaccagcggcacguacgggaccggcuccuggcccgacggggccgaccugaaccugaugcccaucuga

SEQ ID NO: 27385 - RNA, 1410 nt, Artificial Sequence; identical to SEQ ID NO: 16359
  derived and/or modified CDS sequence (AUadapt) from InfluenzaA__AHL98988__NA

SEQ ID NO: 27386 - RNA, 1410 nt, Artificial Sequence; identical to SEQ ID NO: 16339
  derived and/or modified CDS sequence (AUadapt) from InfluenzaA__AHL99000__NA

SEQ ID NO: 27387 - RNA, 1410 nt, Artificial Sequence; identical to SEQ ID NO: 16339
  derived and/or modified CDS sequence (AUadapt) from InfluenzaA__AHL99012__NA

SEQ ID NO: 27388 - RNA, 1410 nt, Artificial Sequence
  derived and/or modified CDS sequence (AUadapt) from InfluenzaA__AHL99024__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcaucugccgggacaacuggaagggcagcaaccgccccaucguggacaucaacaucaaggaccacuccaucgugucguccuacgucugcagcggccuggugggggacaccccgcggaagaacgacuccucguccagcucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggucaucguggaccgcggggaccgguccggcuacucggggaucuucuccguggagggcaagagcugcaucaaccggugcuucuacgucgagcugauccgcggccggaaggaggagaccgaggugcucuggaccucgaacuccaucguggucuucugcgggacgagcggcaccuacgggaccggcuccuggcccgacggggccgaccugaaccugaugcccaucuga

SEQ ID NO: 27389 - RNA, 1410 nt, Artificial Sequence; identical to SEQ ID NO: 25766
  derived and/or modified CDS sequence (AUadapt) from InfluenzaA__AHL99036__NA

SEQ ID NO: 27390 - RNA, 1410 nt, Artificial Sequence; identical to SEQ ID NO: 27188
  derived and/or modified CDS sequence (AUadapt) from InfluenzaA__AHL99048__NA

SEQ ID NO: 27391 - RNA, 1410 nt, Artificial Sequence; identical to SEQ ID NO: 16339
  derived and/or modified CDS sequence (AUadapt) from InfluenzaA__AHL99060__NA

SEQ ID NO: 27392 - RNA, 1410 nt, Artificial Sequence
  derived and/or modified CDS sequence (AUadapt) from InfluenzaA__AHL99072__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaugaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27393 - RNA, 1410 nt, Artificial Sequence
  derived and/or modified CDS sequence (AUadapt) from InfluenzaA__AHL99084__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggaccgcugcuaccaguucgcccuggggcagggcaccacgcucaacaacaugcacuccaacaacaccgugcgggaccgcacccccuaccggacccugcugaugaacgagcucggcguccccuuccaccuggggacgaagcaggucugcaucgccuggucguccucguccugccacgacggcaaggccuggcugcacgugugcaucaccggggacgacaagaacgcgaccgccagcuucaucuacaacggccgccucguggacuccguggugucgugguccaaggagauccugcggacccaggagagcgagugcgucugcaucaacgggacgugcaccguggugaugaccgacggcuccgccucgggcaaggccgacaccaagauccuguucaucgaggaggggaagaucguccacacgagcacccucuccggcucggcgcagcacguggaggagugcuccugcuacccccgcuacccgggggugcggugcgucugccgcgacaacuggaagggcucgaaccggcccaucguggacaucaacaucaaggaccacaacaucguguccagcuacgucugcuccggccuggugggggacacgccccgcaagaacgacucguccagcuccucgcacugccuggaccccaacaacgaggagggcgggcacggcgugaaggggugggccuucgacgacggcaacgacgucuggaugggccggaccaucaacgagaccucccgccucggguacgagaccuucaaggugaucgagggcuggucgaacccgaaguccaagcugcagaucaaccggcaggucaucguggaccgcggggaccggagcggcuacuccgggaucuucucgguggagggcaaguccugcaucaaccgcugcuucuacgucgagcugauccggggccgcaaggaggagaccgaggugcucuggaccagcaacucgaucguggucuucugcgggacguccggcaccuacgggaccggcagcuggcccgacggggccgaccugaaccugaugcccaucuga

SEQ ID NO: 27394 - RNA, 1410 nt, Artificial Sequence; identical to SEQ ID NO: 16339
  derived and/or modified CDS sequence (AUadapt) from InfluenzaA__AHL99096__NA

SEQ ID NO: 27395 - RNA, 1410 nt, Artificial Sequence; identical to SEQ ID NO: 16339
  derived and/or modified CDS sequence (AUadapt) from InfluenzaA__AHL99108__NA

SEQ ID NO: 27396 - RNA, 1410 nt, Artificial Sequence; identical to SEQ ID NO: 16339
  derived and/or modified CDS sequence (AUadapt) from InfluenzaA__AHL99120__NA

SEQ ID NO: 27397 - RNA, 1410 nt, Artificial Sequence; identical to SEQ ID NO: 16339
  derived and/or modified CDS sequence (AUadapt) from InfluenzaA__AHL99132__NA

SEQ ID NO: 27398 - RNA, 1410 nt, Artificial Sequence
  derived and/or modified CDS sequence (AUadapt) from InfluenzaA__AHL99144__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggcggaucgugcacacgucgacccucuccggcucggcgcagcacguggaggagugcuccugcuacccccgcuacccggggguccggugcgugugccgcgacaacuggaagggcagcaaccggcccaucguggacaucaacaucaaggaccacuccaucgucucguccuacgugugcagcggccuggugggggacaccccgcgcaagaacgacuccucguccagcucccacugccuggaccccaacaacgaggagggcgggcacggcgucaaggggugggccuucgacgacggcaacgacguguggaugggccggaccaucaacgagacgucgcgccucggguacgagaccuucaaggucaucgagggcugguccaaccccaagagcaagcugcagaucaaccggcaggucaucguggaccgcggggaccgguccggcuacucggggaucuucuccguggagggcaagagcugcaucaaccgcugcuucuacguggagcugauccggggccgcaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27399 - RNA, 1410 nt, Artificial Sequence; identical to SEQ ID NO: 16339
  derived and/or modified CDS sequence (AUadapt) from InfluenzaA__AHL99156__NA

SEQ ID NO: 27400 - RNA, 1410 nt, Artificial Sequence
  derived and/or modified CDS sequence (AUadapt) from InfluenzaA__AHL99168__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaccaccgagaucguguaccucaccaacacgaccaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcacgacccucaacaacgugcacuccaacaacaccguccgcgaccggacccccuaccgcacgcugcugaugaacgagcucggcgugcccuuccaccuggggaccaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggagauccugcgcacgcaggagagcgagugcgugugcaucaacgggaccugcaccguggucaugaccgacggcuccgccucgggcaaggccgacacgaagauccuguucaucgaggaggggaagaucgugcacaccagcacccucuccggcucggcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacaccccgcggaagaacgacuccagcuccucgucccacugccuggaccccaacaacgaggagggcgggcacggcgucaaggggugggccuucgacgacggcaacgacguguggaugggccgcacgaucaacgagaccucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggacgucgaacuccaucgucguguucugcgggaccagcggcaccuacgggaccggcuccuggcccgacggggccgaccugaaccugaugcccaucuga

SEQ ID NO: 27401 - RNA, 1410 nt, Artificial Sequence; identical to SEQ ID NO: 16339
  derived and/or modified CDS sequence (AUadapt) from InfluenzaA__AHL99180__NA

SEQ ID NO: 27402 - RNA, 1410 nt, Artificial Sequence; identical to SEQ ID NO: 25412
  derived and/or modified CDS sequence (AUadapt) from InfluenzaA__AHL99204__NA

SEQ ID NO: 27403 - RNA, 1410 nt, Artificial Sequence
  derived and/or modified CDS sequence (AUadapt) from InfluenzaA__AHL99216__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacggucgagaaggagaucugccccaagccggccgaguaccggaacuggagcaagccccagugcgggaucaccggcuucgcgcccuucuccaaggacaacucgauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccgucgugagcugguccaaggagauccugcgcacccaggagucggagugcgugugcaucaacgggacgugcaccgucgugaugaccgacggcuccgccagcggcaaggccgacaccaagauccuguucaucgaggaggggaagaucgugcacacgucgacccucuccggcucggcgcagcacgucgaggagugcuccugcuacccccgguacccgggggugcgcugcgugugccgggacaacuggaagggcagcaaccgccccaucaucgacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaagaaggagaccgaggugcucuggaccucgaacuccaucgucguguucugcgggacgagcggcaccuacgggaccggcuccuggcccgacggggccgaccugaaccugaugcccaucuga

SEQ ID NO: 27404 - RNA, 1410 nt, Artificial Sequence; identical to SEQ ID NO: 16339
  derived and/or modified CDS sequence (AUadapt) from InfluenzaA__AHL99228__NA

SEQ ID NO: 27405 - RNA, 1410 nt, Artificial Sequence; identical to SEQ ID NO: 16339
  derived and/or modified CDS sequence (AUadapt) from InfluenzaA__AHL99240__NA

SEQ ID NO: 27406 - RNA, 1410 nt, Artificial Sequence; identical to SEQ ID NO: 16339
  derived and/or modified CDS sequence (AUadapt) from InfluenzaA__AHL99252__NA

SEQ ID NO: 27407 - RNA, 1410 nt, Artificial Sequence; identical to SEQ ID NO: 16339
  derived and/or modified CDS sequence (AUadapt) from InfluenzaA__AHL99264__NA

SEQ ID NO: 27408 - RNA, 1410 nt, Artificial Sequence; identical to SEQ ID NO: 16339
  derived and/or modified CDS sequence (AUadapt) from InfluenzaA__AHL99276__NA

SEQ ID NO: 27409 - RNA, 1410 nt, Artificial Sequence; identical to SEQ ID NO: 26285
  derived and/or modified CDS sequence (AUadapt) from InfluenzaA__AHL99288__NA

SEQ ID NO: 27410 - RNA, 1410 nt, Artificial Sequence; identical to SEQ ID NO: 27188
  derived and/or modified CDS sequence (AUadapt) from InfluenzaA__AHL99300__NA

SEQ ID NO: 27411 - RNA, 1410 nt, Artificial Sequence; identical to SEQ ID NO: 16339
  derived and/or modified CDS sequence (AUadapt) from InfluenzaA__AHL99312__NA

SEQ ID NO: 27412 - RNA, 1410 nt, Artificial Sequence
  derived and/or modified CDS sequence (AUadapt) from InfluenzaA__AHL99324__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugauccugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggcaagcucguggacuccguggucagcugguccaaggagauccugcggacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgcuacccggggguccggugcgugugccgcgacaacuggaagggcagcaaccggcccaucguggacaucaacaucaaggaccacuccaucgucucguccuacgugugcagcggccuggugggggacaccccgcgcaagaacgacuccucguccagcucccacugccuggaccccaacaacgaggagggcgggcacggcgucaaggggugggccuucgacgacggcaacgacguguggaugggccggaccaucaacgagacgucgcgccucggguacgagaccuucaaggucaucgagggcugguccaaccccaagagcaagcugcagaucaaccggcaggucaucguggaccgcggggaccgguccggcuacucggggaucuucuccguggagggcaagagcugcaucaaccgcugcuucuacguggagcugauccggggccgcaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27413 - RNA, 1410 nt, Artificial Sequence; identical to SEQ ID NO: 25791
  derived and/or modified CDS sequence (AUadapt) from InfluenzaA__AHL99348__NA

SEQ ID NO: 27414 - RNA, 1410 nt, Artificial Sequence; identical to SEQ ID NO: 25791
  derived and/or modified CDS sequence (AUadapt) from InfluenzaA__AHL99359__NA

SEQ ID NO: 27415 - RNA, 1410 nt, Artificial Sequence
  derived and/or modified CDS sequence (AUadapt) from InfluenzaA__AHL99370__NA
augaaccccaaccagaagaucaucaccaucggcucggugucccugaccaucacgaccaucugcuucuucaugcagaucgccauccucaucaccaccgucacgcugcacuucaagcaguacgaguucaacucgccgcccaacaaccagaugaugcugugcgagcccaccaucaucgagcgcaacaucaccgagaucguguaccucaccaacacgaccaucgagaaggagaucugccccaagccggccgaguaccggaacugguccaagccccagugcgggaucaccggcuucgcgcccuucagcaaggacaacuccauccgccugucggccgggggcgacaucugggugacccgggagcccuacgucuccugcgacccggacaagugcuaccaguucgcccuggggcagggcacgacccucaacaacgugcacagcaacaacaccgugcgcgaccggacccccuaccgcacgcugcugaugaacgagcucggcguccccuuccaccuggggaccaagcaggucugcaucgccugguccucguccucgugccacgacggcaaggccuggcugcacgugugcaucaccggggacgacaagaacgcgaccgccuccuucaucuacaacggccggcucguggacagcgugguguccuggucgaaggagauccugcgcacgcaggaguccgagugcgucugcaucaacgggaccugcaccguggugaugaccgacggcagcgccuccggcaaggccgacacgaagauccuguucaucgaggaggggaagaucguccacaccucgacccucagcggcuccgcgcagcacguggaggagugcucgugcuacccccgguacccgggggugcgcugcgucugccgggacaacuggaagggcuccaaccgccccaucguggacaucaacaucaaggaccacucgaucguguccagcuacgucugcuccggccuggugggggacacgccccggaagaacgacucguccagcuccucgcacugccuggaccccaacaacgaggagggcgggcacggcgugaaggggugggccuucgacgacggcaacgacgucuggaugggccgcaccaucaacgagaccucccggcucggguacgagaccuucaaggugaucgagggcuggucgaacccgaaguccaagcugcagaucaaccgccaggucaucguggaccgcggggaccggagcggcuacuccgggaucuucucgguggagggcaaguccugcaucaaccggugcuucuacgucgagcugauccgcggccggaaggaggagaccgaggugcucuggacgagcaacucgaucguggucuucugcgggaccuccggcaccuacgggaccggcagcuggcccgacggggccgaccugaaccugaugcccaucuga

SEQ ID NO: 27416 - RNA, 1410 nt, Artificial Sequence; identical to SEQ ID NO: 16339
  derived and/or modified CDS sequence (AUadapt) from InfluenzaA__AHL99393__NA

SEQ ID NO: 27417 - RNA, 1410 nt, Artificial Sequence; identical to SEQ ID NO: 16339
  derived and/or modified CDS sequence (AUadapt) from InfluenzaA__AHL99417__NA

SEQ ID NO: 27418 - RNA, 1410 nt, Artificial Sequence; identical to SEQ ID NO: 16339
  derived and/or modified CDS sequence (AUadapt) from InfluenzaA__AHL99429__NA

SEQ ID NO: 27419 - RNA, 1410 nt, Artificial Sequence; identical to SEQ ID NO: 16339
  derived and/or modified CDS sequence (AUadapt) from InfluenzaA__AHL99441__NA

SEQ ID NO: 27420 - RNA, 1410 nt, Artificial Sequence; identical to SEQ ID NO: 16339
  derived and/or modified CDS sequence (AUadapt) from InfluenzaA__AHL99453__NA

SEQ ID NO: 27421 - RNA, 1410 nt, Artificial Sequence; identical to SEQ ID NO: 16339
  derived and/or modified CDS sequence (AUadapt) from InfluenzaA__AHL99477__NA

SEQ ID NO: 27422 - RNA, 1410 nt, Artificial Sequence; identical to SEQ ID NO: 27188
  derived and/or modified CDS sequence (AUadapt) from InfluenzaA__AHL99489__NA

SEQ ID NO: 27423 - RNA, 1410 nt, Artificial Sequence
  derived and/or modified CDS sequence (AUadapt) from InfluenzaA__AHL99501__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggagauccugcgcacccaggagagcgagugcgugugcaucaacgggacgugcaccguggucaugaccgacggcuccgccucgggcaaggccgacaccaagauccuguucaucgaggaggggaagaucgugcacacgagcacccucuccggcucggcgcagcacguggaggagugcuccugcuacccccgguacccggggguccgcugcgugugccgggacaacuggaagggcucgaaccgccccaucguggacaucaacaucaaggaccacuccaccgucagcuccuacgugugcucgggccuggugggggacaccccgcggaagaacgacuccagcuccucgucccacugccuggaccccaacaacgaggagggcgggcacggcgucaaggggugggccuucgacgacggcaacgacguguggaugggccgcacgaucaacgagaccucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggacgucgaacuccaucgucguguucugcgggaccagcggcaccuacgggaccggcuccuggcccgacggggccgaccugaaccugaugcccaucuga

SEQ ID NO: 27424 - RNA, 1410 nt, Artificial Sequence; identical to SEQ ID NO: 16339
  derived and/or modified CDS sequence (AUadapt) from InfluenzaA__AHL99525__NA

SEQ ID NO: 27425 - RNA, 1410 nt, Artificial Sequence
  derived and/or modified CDS sequence (AUadapt) from InfluenzaA__AHL99537__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggaccucguaccgcacccugcugaugaacgagcucggcgugcccuuccaccuggggacgaagcaggucugcaucgccugguccagcuccucgugccacgacggcaaggccuggcugcacgugugcaucaccggggacgacaagaacgcgaccgccuccuucaucuacaacggccggcucguggacagcguggucuccuggucgaaggagauccugcgcacccaggaguccgagugcgugugcaucaacgggacgugcaccguggucaugaccgacggcagcgccucgggcaaggccgacaccaagauccuguucaucgaggaggggaagaucgugcacacguccacccucagcggcuccgcgcagcacguggaggagugcucgugcuacccccgguaccccgggguccgcugcgugugccgggacaacuggaagggcuccaaccgcccgaucguggacaucaacaucaaggaccacagcaucgucuccucguacgugugcuccggccuggugggggacacgccccggaagaacgacagcuccucguccagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggucgaaccccaaguccaagcugcagaucaaccgccaggugaucguggaccgcggggaccggagcggcuacuccgggaucuucucggucgagggcaagagcugcaucaaccggugcuucuacguggagcugauccgcggccggaaggaggagaccgaggugcucuggaccuccaacucgaucgucguguucugcgggacguccggcaccuacgggaccggcagcuggccggacggggccgaccugaaccugaugcccaucuga

SEQ ID NO: 27426 - RNA, 1410 nt, Artificial Sequence; identical to SEQ ID NO: 26285
  derived and/or modified CDS sequence (AUadapt) from InfluenzaA__AHL99549__NA

SEQ ID NO: 27427 - RNA, 1410 nt, Artificial Sequence; identical to SEQ ID NO: 16339
  derived and/or modified CDS sequence (AUadapt) from InfluenzaA__AHL99561__NA

SEQ ID NO: 27428 - RNA, 1410 nt, Artificial Sequence
  derived and/or modified CDS sequence (AUadapt) from InfluenzaA__AHL99573__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgggggagaaggagaucugccccaagccggccgaguaccggaacuggagcaagccccagugcggcaucaccggguucgcgcccuucuccaaggacaacucgauccgccuguccgccggcggggacaucugggucacccgggagcccuacgugagcugcgacccggacaagugcuaccaguucgcccugggccagggcaccacgcucaacaacgugcacuccaacaacaccguccgcgaccggacccccuaccgcacccugcugaugaacgagcucggggugcccuuccaccugggcacgaagcaggucugcaucgccuggucguccucguccugccacgacgggaaggccuggcugcacgugugcaucaccggcgacgacaagaacgcgaccgccagcuucaucuacaacgggcggcucguggacuccguggucucgugguccaaggagauccugcgcacccaggagagcgagugcgugugcaucaacggcacgugcaccguggucaugaccgacggcuccgccucggggaaggccgacaccaagauccuguucaucgaggagggcaagaucgugcacacgagcacccucuccgggucggcgcagcacguggaggagugcuccugcuacccccgguacccgggcguccgcugcgugugccgggacaacuggaagggcucgaaccgccccaucaucgacaucaacaucaaggaccacuccaucgugagcuccuacgucugcucggggcuggugggcgacaccccgcggaagaacgacuccagcuccucgucccacugccuggaccccaacaacgaggagggcgggcacggggugaagggcugggccuucgacgacggcaacgacgucuggauggggcgcaccaucaacgagacgucgcggcucggcuacgagaccuucaaggugaucgaggggugguccaaccccaagagcaagcugcagaucaaccgccaggucaucguggacaagggcgaccgguccggguacucgggcaucuucuccguggagggcaagagcugcaucaaccgcugcuucuacgucgagcugauccgggggcgcaaggaggagaccgaggugcucuggaccucgaacuccaucguggucuucugcggcacgagcgggaccuacggcaccggguccuggcccgacggcgccgaccugaaccugaugcccaucuga

SEQ ID NO: 27429 - RNA, 1410 nt, Artificial Sequence
  derived and/or modified CDS sequence (AUadapt) from InfluenzaA__AHL99585__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccgcccgcgaccggacccccuaccgcacccugcugaugaacgagcucggcguccccuuccaccuggggacgaagcaggucugcaucgccuggucguccucguccugccacgacggcaaggcguggcugcacgugugcaucaccggggacgacaagaacgccaccgccagcuucaucuacaacggccggcucguggacuccguggugucgugguccaaggagauccugcgcacccaggagagcgagugcgucugcaucaacgggacgugcaccguggugaugaccgacggcuccgccucgggcaaggcggacaccaagauccuguucaucgaggaggggaagaucguccacacgagcacccucuccggcucggcccagcacguggaggagugcuccugcuacccccgguacccgggggugcgcugcgucugccgggacaacuggaagggcucgaaccgccccaucguggacaucaacaucaaggaccacuccaucgugagcuccuacgucugcucgggccuggugggggacaccccgcggaagaacgacuccagcuccucgucccacugccugaaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggucaucguggaccgcggggaccgguccggcuacucggggaucuucuccguggagggcaagagcugcaucaaccggugcuucuacgucgagcugauccgcggccggaaggaggagaccgaggugcucuggaccucgaacuccaucguggucuucugcgggacgagcggcaccuacgggaccggcuccuggcccgacggggccgaccugaaccugaugcccaucuga

SEQ ID NO: 27430 - RNA, 1410 nt, Artificial Sequence
  derived and/or modified CDS sequence (AUadapt) from InfluenzaA__AHL99597__NA
augaaccccaaccagaagaucaucaccaucggcucggugugcaugaccaucgggauggccaaccugauccuccagaucggcaacaucaucuccaucuggaucagccacuccauccaggucgggaaccagagccagaucgagacgugcaaccaguccgugaucaccuacgagaacaacaccugggugaaccagaccuacgucaacaucagcaacacgaacuucgccgugggccaguccguggucagcgugaagcuggcggggaacuccagccugugcccgguguccggcugggccaucuacagcaaggacaacuccguccgcaucggcucgaagggggacguguucgugauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgagguccccagccccuacaacagccgguucgaguccguggccuggagcgccuccgcgugccacgacgggaucaacuggcugaccaucggcaucagcggccccgacuccggggccguggccguccucaaguacaacggcaucaucaccgacaccaucaagucguggcgcaacgacauccugcggacgcaggaguccgagugcgccugcgugaacgggagcugcuucaccaucaugaccgacggcccguccgacggccaggcgagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggcccaacgacaagaccggcagcugcggccccgucuccucgaacggggccaacggcgugaagggguucagcuucaaguacggcaacgggguguggaucggccgcaccaaguccaucagcucccggaagggcuucgagaugaucugggaccccaacggguggaccggcaccgacaacaacuucagcaucaagcaggacaucgucgggaucaacgagugguccggcuacagcggguccuucgugcagcacccggagcucacgggccuggacugcauccgccccugcuucugggucgagcugauccggggccgccccaaggagaacaccaucuggaccagcggguccagcaucuccuucugcggcgugaacagcgacaccguggggugguccuggcccgacggcgccgagcucccguucacgaucgacaaguga

SEQ ID NO: 27431 - RNA, 1410 nt, Artificial Sequence
  derived and/or modified CDS sequence (AUadapt) from InfluenzaA__AHL99608__NA
augaaccccaaccagaagaucaucaccaucggcucggugucccugaccaucucgacgaucugcgucuucaugcagaucgccauccucaucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccgucgugucgugguccaaggagauccugcgcacccaggagagcgagugcgugugcaucaacgggacgugcaccgucgugaugaccgacggcuccgccucgggcaaggccgacaccaagauccuguucaucgaggaggggaagaucgugcacacgagcacccucuccggcucggcgcagcacgucgaggagugcuccugcuacccccgguacccgggggugcgcugcgugugccgggacaacuggaagggcucgaaccgccccaucgucgacaucaacaucaaggaccacuccaucgugagcuccuacgugugcucgggccuggucggggacaccccgcggaagaacgacuccagcuccucgucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggugaucgucgaccgcggggaccgguccggcuacucggggaucuucuccguggagggcaagagcugcaucaaccggugcuucuacguggagcugauccgcggccggaaggaggagaccgagguccucuggaccucgaacuccaucgugguguucugcgggacgagcggcaccuacgggaccggcuccuggcccgacggggccgaccugaaccugaugcccaucuga

SEQ ID NO: 27432 - RNA, 1410 nt, Artificial Sequence
  derived and/or modified CDS sequence (AUadapt) from InfluenzaA__AHL99620__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggcaagcucguggacuccguggucagcugguccaaggagauccugcggacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgcuacccggggguccggugcgugugccgcgacaacuggaagggcagcaaccggcccaucguggacaucaacaucaaggaccacuccaucgucucguccuacgugugcagcggccuggugggggacaccccgcgcaagaacgacuccucguccagcucccacugccuggaccccaacaacgaggagggcgggcacggcgucaaggggugggccuucgacgacggcaacgacguguggaugggccggaccaucaacgagacgucgcgccucggguacgagaccuucaaggucaucgagggcugguccaaccccaagagcaagcugcagaucaaccggcaggucaucguggaccgcggggaccgguccggcuacucggggaucuucuccguggagggcaagagcugcaucaaccgcugcuucuacguggagcugauccggggccgcaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27433 - RNA, 1410 nt, Artificial Sequence
  derived and/or modified CDS sequence (AUadapt) from InfluenzaA__AHL99632__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaccaucgagcgcaacaucaccgagaucguguaccucaccaacacgaccaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcacgacccucaacaacgugcacuccaacaacaccguccgcgaccggacccccuaccgcacgcugcugaugaacgagcucggcgugcccuuccaccuggggaccaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggagauccugcgcacgcaggagagcgagugcgugugcaucaacgggaccugcaccguggucaugaccgacggcuccgccucgggcaaggccgacacgaagauccuguucaucgaggaggggaagaucgugcacaccagcacccucuccggcucggcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacaccccgcggaagaacgacuccagcuccucgucccacugccuggaccccaacaacgaggagggcgggcacggcgucaaggggugggccuucgacgacggcaacgacguguggaugggccgcacgaucaacgagaccucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggacgucgaacuccaucgucguguucugcgggaccagcggcaccuacgggaccggcuccuggcccgacggggccgaccugaaccugaugcccaucuga

SEQ ID NO: 27434 - RNA, 1410 nt, Artificial Sequence; identical to SEQ ID NO: 27223
  derived and/or modified CDS sequence (AUadapt) from InfluenzaA__AHL99644__NA

SEQ ID NO: 27435 - RNA, 1410 nt, Artificial Sequence
  derived and/or modified CDS sequence (AUadapt) from InfluenzaA__AHL99668__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacggucgagaaggagaucugccccaagccggccgaguaccggaacuggagcaagccccagugcgggaucaccggcuucgcgcccuucuccaaggacaacucgauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccgucgugagcugguccaaggagauccugcgcacccaggagucggagugcgugugcaucaacgggacgugcaccgucgugaugaccgacggcuccgccagcggcaaggccgacaccaagauccuguucaucgaggaggggaagaucgugcacacgucgacccucuccggcucggcgcagcacgucgaggagugcuccugcuacccccgguacccgggggugcgcugcgugugccgggacaacuggaagggcagcaaccgccccaucaucgacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27436 - RNA, 1410 nt, Artificial Sequence; identical to SEQ ID NO: 16339
  derived and/or modified CDS sequence (AUadapt) from InfluenzaA__AHL99680__NA

SEQ ID NO: 27437 - RNA, 1410 nt, Artificial Sequence
  derived and/or modified CDS sequence (AUadapt) from InfluenzaA__AHL99692__NA
augaaccccaaccagaagaucaucaccaucggcucggugucccugaccaucucgacgaccugcuucuucaugcagaucgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcacgacccucaacaacgugcacuccaacaacaccguccgcgaccggacccccuaccgcacgcugcugaugaacgagcucggcgugcccuuccaccuggggaccaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggagauccugcgcacgcaggagagcgagugcgugugcaucaacgggaccugcaccguggucaugaccgacggcuccgccucgggcaaggccgacacgaagauccuguucaucgaggaggggaagaucgugcacaccagcacccucuccggcucggcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacaccccgcggaagaacgacuccagcuccucgucccacugccuggaccccaacaacgaggagggcgggcacggcgucaaggggugggccuucgacgacggcaacgacguguggaugggccgcacgaucaacgagaccucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggacgucgaacuccaucgucguguucugcgggaccagcggcaccuacgggaccggcuccuggcccgacggggccgaccugaaccugaugcccaucuga

SEQ ID NO: 27438 - RNA, 1410 nt, Artificial Sequence; identical to SEQ ID NO: 16339
  derived and/or modified CDS sequence (AUadapt) from InfluenzaA__AHL99704__NA

SEQ ID NO: 27439 - RNA, 1410 nt, Artificial Sequence; identical to SEQ ID NO: 16339
  derived and/or modified CDS sequence (AUadapt) from InfluenzaA__AHL99716__NA

SEQ ID NO: 27440 - RNA, 1410 nt, Artificial Sequence; identical to SEQ ID NO: 27430
  derived and/or modified CDS sequence (AUadapt) from InfluenzaA__AHL99740__NA

SEQ ID NO: 27441 - RNA, 1410 nt, Artificial Sequence
  derived and/or modified CDS sequence (AUadapt) from InfluenzaA__AHL99751__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacggucgagaaggagaucugccccaagccggccgaguaccggaacuggagcaagccccagugcgggaucaccggcuucgcgcccuucuccaaggacaacucgauccgccuguccgccgggggcgacaucugggugacccgggagcccuacgugagcugcgacccggacaagugcuaccaguucgcccuggggcagggcaccacgcucaacaacguccacuccaacaacaccgcccgcgaccggacccccuaccgcacccugcugaugaacgagcucggcgugcccuuccaccuggggacgaagcaggucugcaucgccuggucguccucguccugccacgacggcaaggcguggcugcacgugugcaucaccggggacgacaagaacgccaccgccagcuucaucuacaacggccggcucguggacuccguggucucgugguccaaggagauccugcgcacccaggagagcgagugcgugugcaucaacgggacgugcaccguggucaugaccgacggcuccgccucgggcaaggcggacaccaagauccuguucaucgaggaggggaagaucgugcacacgagcacccucuccggcucggcccagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacaccccgcggaagaacgacuccagcuccucgucccacugccugaaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27442 - RNA, 1410 nt, Artificial Sequence
  derived and/or modified CDS sequence (AUadapt) from InfluenzaA__AHL99763__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaugaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27443 - RNA, 1410 nt, Artificial Sequence; identical to SEQ ID NO: 16339
  derived and/or modified CDS sequence (AUadapt) from InfluenzaA__AHL99775__NA

SEQ ID NO: 27444 - RNA, 1410 nt, Artificial Sequence
  derived and/or modified CDS sequence (AUadapt) from InfluenzaA__AHL99787__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacacgccccggaagaacgacuccucguccagcucccacugccuggaccccaacaacgaggagggcgggcacggcgucaaggggugggccuucgacgacggcaacgacguguggaugggccgcaccaucaacgagaccucgcggcucggguacgagaccuucaaggucaucgagggcugguccaacccggagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27445 - RNA, 1410 nt, Artificial Sequence
  derived and/or modified CDS sequence (AUadapt) from InfluenzaA__AHL99799__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcaucugccgggacaacuggaagggcagcaaccgccccaucguggacaucaacaucaaggaccacuccaucgugucguccuacgucugcagcggccuggugggggacaccccgcggaagaacgacuccucguccagcucccacugccugggccccaacaacgaggagggcgggcacggggugaagggcugggccuucgacgacggcaacgacgucuggauggggcgcaccaucaacgagacgucgcggcucggcuacgagaccuucaaggugaucgaggggugguccaaccccaagagcaagcugcagaucaaccgccaggucaucguggaccggggcgaccgcuccggguacucgggcaucuucuccguggagggcaagagcugcaucaaccggugcuucuacgucgagcugauccgcgggcggaaggaggagaccgaggugcucuggaccucgaacuccaucguggucuucugcggcacgagcgggaccuacggcaccggguccuggcccgacggcgccgaccugaaccugaugcccaucuga

SEQ ID NO: 27446 - RNA, 1410 nt, Artificial Sequence; identical to SEQ ID NO: 16339
  derived and/or modified CDS sequence (AUadapt) from InfluenzaA__AHL99811__NA

SEQ ID NO: 27447 - RNA, 1410 nt, Artificial Sequence
  derived and/or modified CDS sequence (AUadapt) from InfluenzaA__AHL99823__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcgccguggucaugaccgacggcuccgccagcggcaaggcggacaccaagauccuguucaucgaggaggggaagaucgugcacaccucgacgcucuccggcucggcccagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagaccucgcggcucggguacgagacguucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggaccagcggcacguacgggaccggcuccuggcccgacggggccgaccugaaccugaugcccaucuga

SEQ ID NO: 27448 - RNA, 1410 nt, Artificial Sequence
  derived and/or modified CDS sequence (AUadapt) from InfluenzaA__AHL99835__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggucgaagccccagugcgggaucaccggcuucgcgcccuucuccaaggacaacagcauccgccuguccgccgggggcgacaucugggucacccgggagcccuacgugucgugcgccccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccucguccugccacgacggcaaggcguggcugcacgugugcaucaccggggacgacaagaacgccaccgccagcuucaucuacaacggccggcucguggacuccguggucucgugguccaaggagauccugcgcacccaggagagcgagugcgugugcaucaacgggacgugcaccguggucaugaccgacggcuccgccucgggcaaggcggacaccaagauccuguucaucgaggaggggaagaucgugcacacgagcacccucuccggcucggcccagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcugaucaaccgccaggugaucguggaccgcggggaccgguccggcuacucggggaucuucuccgucgagggcaagagcugcaucaaccggugcuucuacguggagcucauccgcggccggaaggaggagaccgaggugcuguggaccucgaacuccaucgucguguucugcgggacgagcggcaccuacgggaccggcuccuggcccgacggggccgaccugaaccucaugcccaucuga

SEQ ID NO: 27449 - RNA, 1410 nt, Artificial Sequence; identical to SEQ ID NO: 16339
  derived and/or modified CDS sequence (AUadapt) from InfluenzaA__AHL99847__NA

SEQ ID NO: 27450 - RNA, 1410 nt, Artificial Sequence; identical to SEQ ID NO: 25777
  derived and/or modified CDS sequence (AUadapt) from InfluenzaA__AHL99859__NA

SEQ ID NO: 27451 - RNA, 1410 nt, Artificial Sequence
  derived and/or modified CDS sequence (AUadapt) from InfluenzaA__AHL99871__NA
augaaccccaaccagaagaucaucaccaucggcucggugucccugaccaucucgacgaucugcuucuucaugcagaucgccauccucaccaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugucgugcgacccggacaagugcuaccaguucgcccugggccaggggacgacccucaacaacgugcacuccaacaacaccguccgcgaccggacccccuaccgcacgcugcugaugaacgagcucggcgugcccuuccaccugggcaccaagcaggucugcaucgccuggagcuccucguccugccacgacgggaaggccuggcugcacgugugcaucaccggcgacgacaagaacgcgaccgccagcuucaucuacaacgggcggcucguggacuccguggucucgugguccaaggagauccugcgcacgcaggagucggagugcgugugcaucaacgggaccugcaccguggucaugaccgacggguccgccagcggcaaggccgacacgaagauccuguucaucgaggagggccggaucgugcacaccucgacccucuccgggucggcgcagcacguggaggagugcuccugcuacccccgcuacccgggcguccggugcgugugccgcgacaacuggaaggggagcaaccggcccaucguggacaucaacaucaaggaccacuccaucgucucgcgcuacgugugcuccggccuggugggcgacacgccccggaagaacgacagcuccucguccucgcacugccuggaccccaacaacgaggagggcggccacggggucaagggcugggccuucgacgacgggaacgacguguggaugggccgcaccaucaacgagaccucccggcucggcuacgagaccuucaaggucaucgagggguggagcaacccgaaguccaagcugcagaucaaccgccaggugaucguggaccggggcgaccgcucgggguacuccggcaucuucucggucgaggggaaguccugcaucaaccggugcuucuacguggagcugauccgcggccgcaaggaggagaccgaggugcucuggacgagcaacucgaucgucguguucugcggcaccuccgggaccuacggcaccgggagcuggcccgacggcgccgaccugaaccugaugcccaucuga

SEQ ID NO: 27452 - RNA, 1410 nt, Artificial Sequence; identical to SEQ ID NO: 16339
  derived and/or modified CDS sequence (AUadapt) from InfluenzaA__AHL99883__NA

SEQ ID NO: 27453 - RNA, 1410 nt, Artificial Sequence; identical to SEQ ID NO: 27429
  derived and/or modified CDS sequence (AUadapt) from InfluenzaA__AHL99895__NA

SEQ ID NO: 27454 - RNA, 1410 nt, Artificial Sequence; identical to SEQ ID NO: 16339
  derived and/or modified CDS sequence (AUadapt) from InfluenzaA__AHL99907__NA

SEQ ID NO: 27455 - RNA, 1410 nt, Artificial Sequence; identical to SEQ ID NO: 16339
  derived and/or modified CDS sequence (AUadapt) from InfluenzaA__AHL99919__NA

SEQ ID NO: 27456 - RNA, 1410 nt, Artificial Sequence
  derived and/or modified CDS sequence (AUadapt) from InfluenzaA__AHL99943__NA
augaaccccaaccagaagaucaucaccaucggcucggugucccugaccaucucgacgaucugcuucuucaugcagaucgccauccucaucaccaccgucacccugcacuucaagcagcacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggagauccugcgcacccaggagagcgagugcgugugcaucaacgggacgugcaccguggucaugaccgacggcuccgccucgggcaaggccgacaccaagauccuguucaucgaggaggggaagaucgugcacacgagcacccucuccggcucggcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacaccccgcggaagaacgacuccagcuccucgucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27457 - RNA, 1410 nt, Artificial Sequence; identical to SEQ ID NO: 16339
  derived and/or modified CDS sequence (AUadapt) from InfluenzaA__AHL99955__NA

SEQ ID NO: 27458 - RNA, 1410 nt, Artificial Sequence
  derived and/or modified CDS sequence (AUadapt) from InfluenzaA__AHL99967__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccacgaccgcacccccuaccggacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccgccucguggacuccguggucagcugguccaaggagauccugcggacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgcuacccggggguccggugcgugugccgcgacaacuggaagggcagcaaccggcccaucguggacaucaacaugaaggaccacuccaucgucucguccuacgugugcagcggccuggugggggacaccccgcgcaagaacgacuccucguccagcucccacugccuggaccccaacaacgaggagggcgggcacggcgucaaggggugggccuucgacgacggcaacgacguguggaugggccggaccaucaacgagacgucgcgccucggguacgagaccuucaaggucaucgagggcugguccaaccccaagagcaagcugcagaucaaccggcaggucaucguggaccgcggggaccgguccggcuacucggggaucuucuccguggagggcaagagcugcaucaaccgcugcuucuacguggagcugauccggggccgcaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27459 - RNA, 1410 nt, Artificial Sequence
  derived and/or modified CDS sequence (AUadapt) from InfluenzaA__AHL99979__NA
augaaccccaaccagaagaucaucaccaucggcucggugucccugaccaucucgacgaucugcuucuucaugcagaucgccauccucaucaccaccgucgcccugcacuucaagcagcacgaguucaacuccccgcccaacaaccaggugaugcugugcgagcccaccaucaucgagcgcaacaucacggagaucguguaccucaccaacaccaccaucgagaaggagaucugccccaagccggcggaguaccggaacuggagcaagccccagugcgggaucacgggcuucgcccccuucuccaaggacaacucgauccgccuguccgccgggggcgacaucugggucacccgggagcccuacgugagcugcgacccggacaagugcuaccaguucgcccuggggcagggcaccacccucaacaacgugcacuccaacaacacgguccgcgaccggacccccuaccgcacccugcugaugaacgagcucggcgugcccuuccaccuggggaccaagcaggucugcaucgccuggucguccucguccugccacgacggcaaggcguggcugcacgugugcaucacgggggacgacaagaacgccaccgccagcuucaucuacaacggccggcucguggacuccguggucucgugguccaaggagauccugcgcacccaggagagcgagugcgugugcaucaacgggaccugcacgguggucaugaccgacggcuccgccucgggcaaggcggacaccaagauccuguucaucgaggaggggaagaucgugcacaccagcacgcucuccggcucggcccagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacaccccgcggaagaacgacuccagcuccucgucccacugccuggaccccaacaacgaggagggcgggcacggcgucaaggggugggccuucgacgacggcaacgacguguggaugggccgcaccaucaacgagaccucgcggcucggguacgagacguucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggaccagcggcacguacgggaccggcuccuggcccgacggggccgaccugaaccugaugcccaucuga

SEQ ID NO: 27460 - RNA, 1410 nt, Artificial Sequence; identical to SEQ ID NO: 27456
  derived and/or modified CDS sequence (AUadapt) from InfluenzaA__AHL99991__NA

SEQ ID NO: 27461 - RNA, 1410 nt, Artificial Sequence; identical to SEQ ID NO: 16339
  derived and/or modified CDS sequence (AUadapt) from InfluenzaA__AHM00004__NA

SEQ ID NO: 27462 - RNA, 1410 nt, Artificial Sequence; identical to SEQ ID NO: 16339
  derived and/or modified CDS sequence (AUadapt) from InfluenzaA__AHM00016__NA

SEQ ID NO: 27463 - RNA, 1410 nt, Artificial Sequence; identical to SEQ ID NO: 16339
  derived and/or modified CDS sequence (AUadapt) from InfluenzaA__AHM00028__NA

SEQ ID NO: 27464 - RNA, 1410 nt, Artificial Sequence; identical to SEQ ID NO: 27456
  derived and/or modified CDS sequence (AUadapt) from InfluenzaA__AHM00040__NA

SEQ ID NO: 27465 - RNA, 1410 nt, Artificial Sequence; identical to SEQ ID NO: 16339
  derived and/or modified CDS sequence (AUadapt) from InfluenzaA__AHM00052__NA

SEQ ID NO: 27466 - RNA, 1410 nt, Artificial Sequence; identical to SEQ ID NO: 25412
  derived and/or modified CDS sequence (AUadapt) from InfluenzaA__AHM00064__NA

SEQ ID NO: 27467 - RNA, 1410 nt, Artificial Sequence; identical to SEQ ID NO: 16339
  derived and/or modified CDS sequence (AUadapt) from InfluenzaA__AHM00076__NA

SEQ ID NO: 27468 - RNA, 1410 nt, Artificial Sequence; identical to SEQ ID NO: 16339
  derived and/or modified CDS sequence (AUadapt) from InfluenzaA__AHM00088__NA

SEQ ID NO: 27469 - RNA, 1410 nt, Artificial Sequence
  derived and/or modified CDS sequence (AUadapt) from InfluenzaA__AHM00100__NA
augaaccccaaccagaagaucaucaccaucggcucgaucugcaugaccaucgggauggccaaccugauccuccagaucggcaacaucaucuccaucuggaucagccacuccauccagcuggggaaccagagccagaucgagacgugcaaccaguccgugaucaccuacgagaacaacaccugggucaaccagaccuacgugaacaucagcaacacgaacuucgccgcgggccaguccguggucucggugaagcuggccgggaacuccagccucugcccgguguccggcugggccaucuacagcaaggacaacuccauccgcaucggcagcaagggggacgucuucgugauccgggagcccuucaucuccugcucgccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccgucgccuggucggcguccgccugccacgacgggaucaacuggcucaccaucggcaucagcggccccgacaacggggccguggccgugcugaaguacaacggcgucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagucgguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucucguccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccacgaagcaggacaucgucgggaucaacgaguggucgggcuacuccgggagcuucgugcagcacccggagcugaccggccuggacugcauccgccccugcuucuggguggagcucauccggggccgccccaaggagaacaccaucuggaccuccgggagcuccaucagcuucugcggcgucaacuccgacacggugggguggagcuggcccgacggcgccgagcugccguucaccaucgacaacuga

SEQ ID NO: 27470 - RNA, 1410 nt, Artificial Sequence; identical to SEQ ID NO: 27392
  derived and/or modified CDS sequence (AUadapt) from InfluenzaA__AHM00111__NA

SEQ ID NO: 27471 - RNA, 1410 nt, Artificial Sequence; identical to SEQ ID NO: 27456
  derived and/or modified CDS sequence (AUadapt) from InfluenzaA__AHM00123__NA

SEQ ID NO: 27472 - RNA, 1410 nt, Artificial Sequence; identical to SEQ ID NO: 25777
  derived and/or modified CDS sequence (AUadapt) from InfluenzaA__AHM00135__NA

SEQ ID NO: 27473 - RNA, 1410 nt, Artificial Sequence; identical to SEQ ID NO: 26285
  derived and/or modified CDS sequence (AUadapt) from InfluenzaA__AHM00147__NA

SEQ ID NO: 27474 - RNA, 1410 nt, Artificial Sequence; identical to SEQ ID NO: 27456
  derived and/or modified CDS sequence (AUadapt) from InfluenzaA__AHM00159__NA

SEQ ID NO: 27475 - RNA, 1410 nt, Artificial Sequence; identical to SEQ ID NO: 16339
  derived and/or modified CDS sequence (AUadapt) from InfluenzaA__AHM00171__NA

SEQ ID NO: 27476 - RNA, 1410 nt, Artificial Sequence; identical to SEQ ID NO: 16339
  derived and/or modified CDS sequence (AUadapt) from InfluenzaA__AHM00183__NA

SEQ ID NO: 27477 - RNA, 1410 nt, Artificial Sequence
  derived and/or modified CDS sequence (AUadapt) from InfluenzaA__AHM00195__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccucguccugccacgacgggaaggccuggcugcacgugugcaucaccggcgacgacaagaacgcgaccgccagcuucaucuacaacgggcggcucguggacuccguggucucgugguccaaggagauccugcgcacccaggagagcgagugcgugugcaucaacggcacgugcaccguggucaugaccgacggguccgccucgggcaaggccgacaccaaggugcuguucaucgaggagggcaagaucgugcacacgagcacccucuccgggucggcgcagcacgucgaggagugcuccugcuacccccgguacccgggcgugcgcugcgugugccgggacaacuggaaggggucgaaccgccccaucgucgacaucaacaucaaggaccacuccaucgugagccgguacgugugcuccggccuggucggcgacacgccccgcaagaacgacucguccagcuccucgcacugccuggaccccaacaacgaggagggcgggcacggggugaagggcugggccuucgacgacgggaacgacgucuggaugggccggaccaucaacgagaccucccgccucggcuacgagaccuucaaggugaucgagggguggucgaacccgaaguccaagcugcagaucaaccgccaggugaucgucgaccggggcgaccggagcggguacuccggcaucuucucgguggaggggaaguccugcaucaaccgcugcuucuacguggagcugauccggggccgcaaggaggagaccgagguccucuggaccagcaacucgaucgugguguucugcggcacguccgggaccuacggcaccgggagcuggcccgacggcgccgaccugaaccugaugcccaucuga

SEQ ID NO: 27478 - RNA, 1410 nt, Artificial Sequence
  derived and/or modified CDS sequence (AUadapt) from InfluenzaA__AHM00207__NA
augaaccccaaccagaagaucaucaccaucggcucggugucccugaccaucucgacgaucugcuucuucaugcagaucgccauccucaucaccaccgucacccugcacuucaagcagcacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcaacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggagauccugcgcacccaggagagcgagugcgugugcaucaacgggacgugcaccguggucaugaccgacggcuccgccucgggcaaggccgacaccaagauccuguucaucgaggaggggaagaucgugcacacgagcacccucuccggcucggcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacaccccgcggaagaacgacuccagcuccucgucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27479 - RNA, 1410 nt, Artificial Sequence; identical to SEQ ID NO: 27456
  derived and/or modified CDS sequence (AUadapt) from InfluenzaA__AHM00219__NA

SEQ ID NO: 27480 - RNA, 1410 nt, Artificial Sequence; identical to SEQ ID NO: 16339
  derived and/or modified CDS sequence (AUadapt) from InfluenzaA__AHM00231__NA

SEQ ID NO: 27481 - RNA, 1410 nt, Artificial Sequence; identical to SEQ ID NO: 16339
  derived and/or modified CDS sequence (AUadapt) from InfluenzaA__AHM00243__NA

SEQ ID NO: 27482 - RNA, 1410 nt, Artificial Sequence; identical to SEQ ID NO: 16339
  derived and/or modified CDS sequence (AUadapt) from InfluenzaA__AHM00255__NA

SEQ ID NO: 27483 - RNA, 1410 nt, Artificial Sequence
  derived and/or modified CDS sequence (AUadapt) from InfluenzaA__AHM00267__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccguggccucgugguccaaggagauccugcgcacccaggagagcgagugcgucugcaucaacgggacgugcaccguggugaugaccgacggcuccgccucgggcaaggcggacaccaagauccuguucaucgaggaggggaagaucguccacacgagcacccucuccggcucggcccagcacguggaggagugcuccugcuacccccgguacccgggggugcgcugcgucugccgggacaacuggaagggcucgaaccgccccaucguggacaucaacaucaaggaccacuccaucgugagcuccuacgucugcucgggccuggugggggacaccccgcggaagaacgacuccagcuccucgucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggucaucguggaccgcggggaccgguccggcuacucggggaucuucuccguggagggcaagagcugcaucaaccggugcuucuacgucgagcugauccgcggccggaaggaggagaccgaggugcucuggaccucgaacuccaucguggucuucugcgggacgagcggcaccuacgggaccggcuccuggcccgacggggccgaccugaaccugaugcccaucuga

SEQ ID NO: 27484 - RNA, 1410 nt, Artificial Sequence; identical to SEQ ID NO: 25777
  derived and/or modified CDS sequence (AUadapt) from InfluenzaA__AHM00279__NA

SEQ ID NO: 27485 - RNA, 1410 nt, Artificial Sequence; identical to SEQ ID NO: 16339
  derived and/or modified CDS sequence (AUadapt) from InfluenzaA__AHM00291__NA

SEQ ID NO: 27486 - RNA, 1410 nt, Artificial Sequence; identical to SEQ ID NO: 16339
  derived and/or modified CDS sequence (AUadapt) from InfluenzaA__AHM00303__NA

SEQ ID NO: 27487 - RNA, 1410 nt, Artificial Sequence; identical to SEQ ID NO: 16339
  derived and/or modified CDS sequence (AUadapt) from InfluenzaA__AHM00315__NA

SEQ ID NO: 27488 - RNA, 1410 nt, Artificial Sequence; identical to SEQ ID NO: 25777
  derived and/or modified CDS sequence (AUadapt) from InfluenzaA__AHM00327__NA

SEQ ID NO: 27489 - RNA, 1410 nt, Artificial Sequence; identical to SEQ ID NO: 25777
  derived and/or modified CDS sequence (AUadapt) from InfluenzaA__AHM00339__NA

SEQ ID NO: 27490 - RNA, 1410 nt, Artificial Sequence; identical to SEQ ID NO: 27456
  derived and/or modified CDS sequence (AUadapt) from InfluenzaA__AHM00351__NA

SEQ ID NO: 27491 - RNA, 1410 nt, Artificial Sequence; identical to SEQ ID NO: 27392
  derived and/or modified CDS sequence (AUadapt) from InfluenzaA__AHM00363__NA

SEQ ID NO: 27492 - RNA, 1410 nt, Artificial Sequence
  derived and/or modified CDS sequence (AUadapt) from InfluenzaA__AHM00375__NA
augaaccccaaccagaagaucaucaccaucggcucggugucccugaccaucucgacgaucugcuucuucaugcagaucgccauccucaucaccaccgucacccugcacuucaagcagcacgaguucaacuccccgcccaacaaccaggugaugcugugcgagcccacgaucaucgagcgcaacaucaccgagaucguguaccucaccaacaccacgaucgagaaggaggucugccccaagccggccgaguaccggaacuggagcaagccccagugcgggaucaccggcuucgcgcccuucuccaaggacaacucgauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccgucgugucgugguccaaggagauccugcgcacccaggagagcgagugcgugugcaucaacgggacgugcaccgucgugaugaccgacggcuccgccucgggcaaggccgacaccaagauccuguucaucgaggaggggaagaucgugcacacgagcacccucuccggcucggcgcagcacgucgaggagugcuccugcuacccccgguacccgggggugcgcugcgugugccgggacaacuggaagggcucgaaccgccccaucgucgacaucaacaucaaggaccacuccaucgugagcuccuacgugugcucgggccuggucggggacaccccgcggaagaacgacuccagcuccucgucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggugaucgucgaccgcggggaccgguccggcuacucggggaucuucuccguggagggcaagagcugcaucaaccggugcuucuacguggagcugauccgcggccggaaggaggagaccgagguccucuggaccucgaacuccaucgugguguucugcgggacgagcggcaccuacgggaccggcuccuggcccgacggggccgaccugaaccugaugcccaucuga

SEQ ID NO: 27493 - RNA, 1410 nt, Artificial Sequence
  derived and/or modified CDS sequence (AUadapt) from InfluenzaA__AHM00398__NA
augaaccccaaccagaagaucaucaccaucggcucggugucccugaccaucucgacgaucugcuucuucaugcagaucgccauccucaucaccaccgucacccugcacuucaagcagcacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggagaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucucgugguccaaggagauccugcgcacccaggagagcgagugcgugugcaucaacgggacgugcaccguggucaugaccgacggcuccgccucgggcaaggccgacaccaagauccuguucaucgaggaggggaagaucgugcacacgagcacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccucgucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagucgaagcugcagaucaaccgccaggugaucguggaccgcggggaccgguccggcuacagcgggaucuucuccgucgagggcaagucgugcaucaaccggugcuucuacguggagcugauccgcggccggaaggaggagaccgaggugcucuggaccagcuccucgaucgucguguucugcgggacguccggcaccuacgggaccggcagcuggcccgacggggccgaccugaaccugaugcccaucuga

SEQ ID NO: 27494 - RNA, 1410 nt, Artificial Sequence; identical to SEQ ID NO: 16339
  derived and/or modified CDS sequence (AUadapt) from InfluenzaA__AHM00410__NA

SEQ ID NO: 27495 - RNA, 1410 nt, Artificial Sequence
  derived and/or modified CDS sequence (AUadapt) from InfluenzaA__AHM00422__NA
augaaccccaaccagaagaucaucaccaucggcucggugucccugaccaucucgacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccgucgugagcugguccaaggagauccugcgcacccaggagucggagugcgugugcaucaacgggacgugcaccgucgugaugaccgacggcuccgccagcggcaaggccgacaccaagauccuguucaucgaggaggggaagaucgugcacacgucgacccucuccggcucggcgcagcacgucgaggagugcuccugcuacccccgguacccgggggugcgcugcgugugccgggacaacuggaagggcagcaaccgccccaucgucgacaucaacaucaaggaccacuccaucgugucguccuacgugugcagcggccuggucggggacaccccgcggaagaacgacuccucguccagcucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggugaucgucgaccgcggggaccgguccggcuacucggggaucuucuccguggagggcaagagcugcaucaaccggugcuucuacguggagcugauccgcggccggaaggaggagaccgagguccucuggaccucgaacuccaucgugguguucugcgggacgagcggcaccuacgggaccggcuccuggcccgacggggccgaccugaaccugaugcccaucuga

SEQ ID NO: 27496 - RNA, 1410 nt, Artificial Sequence
  derived and/or modified CDS sequence (AUadapt) from InfluenzaA__AHM00434__NA
augaaccccaaccagaagaucaucaccaucggcucggugucccugaccaucucgacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcccgccgaguaccggaacugguccaagccccagugcgggaucaccggcuucgcgcccuucagcaaggacaacuccauccgccugucggccgggggcgacaucugggucacccgggagccguacguguccugcgaccccgacaagugcuaccaguucgcccuggggcagggcaccacgcucaacaacgugcacagcaacaacaccguccgcgaccggacccccuaccgcacccugcugaugaacgagcucggcgugcccuuccaccuggggacgaagcaggucugcaucgccugguccucguccucgugccacgacggcaaggccuggcugcacgugugcaucaccggggacgacaagaacgcgaccgccuccuucaucuacaacggccggcucguggacagcguggucuccuggucgaaggagauccugcgcacccaggaguccgagugcgugugcaucaacgggacgugcaccguggucaugaccgacggcagcgccuccggcaaggccgacaccaagauccuguucaucgaggaggggaagaucgugcacacgucgacccucagcggcuccgcgcagcacguggaggagugcucgugcuacccgcgguaccccgggguccgcugcgugugccgggacaacuggaagggcuccaaccgccccaucguggacaucaacaucaaggaccacucgaucgucuccagcuacgugugcuccggccuggugggggacacgccccggaagaacgacucguccagcuccucgcacugccuggacccgaacaacgaggagggcgggcacggcgucaaggggugggccuucgacgacggcaacgacguguggaugggccgcaccaucaacgagaccucccggcucggguacgagaccuucaaggucaucgagggcuggucgaaccccaaguccaagcugcagaucaaccgccaggugaucguggaccgcggggaccggagcggcuacuccgggaucuucucggucgagggcaaguccugcaucaaccggugcuucuacguggagcugauccgcggccggaaggaggagaccgaggugcucuggaccagcaacucgaucgucguguucugcgggacguccggcaccuacgggaccggcagcuggcccgacggggccgaccugaaccugaugcccaucuga

SEQ ID NO: 27497 - RNA, 1410 nt, Artificial Sequence; identical to SEQ ID NO: 16339
  derived and/or modified CDS sequence (AUadapt) from InfluenzaA__AHM00446__NA

SEQ ID NO: 27498 - RNA, 1410 nt, Artificial Sequence; identical to SEQ ID NO: 27456
  derived and/or modified CDS sequence (AUadapt) from InfluenzaA__AHM00458__NA

SEQ ID NO: 27499 - RNA, 1410 nt, Artificial Sequence; identical to SEQ ID NO: 27456
  derived and/or modified CDS sequence (AUadapt) from InfluenzaA__AHM00470__NA

SEQ ID NO: 27500 - RNA, 1410 nt, Artificial Sequence; identical to SEQ ID NO: 27456
  derived and/or modified CDS sequence (AUadapt) from InfluenzaA__AHM00482__NA

SEQ ID NO: 27501 - RNA, 1410 nt, Artificial Sequence; identical to SEQ ID NO: 27456
  derived and/or modified CDS sequence (AUadapt) from InfluenzaA__AHM00494__NA

SEQ ID NO: 27502 - RNA, 1410 nt, Artificial Sequence
  derived and/or modified CDS sequence (AUadapt) from InfluenzaA__AHM00506__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucgugaaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27503 - RNA, 1410 nt, Artificial Sequence; identical to SEQ ID NO: 16339
  derived and/or modified CDS sequence (AUadapt) from InfluenzaA__AHM00518__NA

SEQ ID NO: 27504 - RNA, 1410 nt, Artificial Sequence
  derived and/or modified CDS sequence (AUadapt) from InfluenzaA__AHM00530__NA
augaaccccaaccagaagaucaucaccaucggcucggugucccugaccaucucgacgaucugcuucuccaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcccgccgaguaccggaacuggagcaagccccagugcgggaucaccggcuucgcgcccuucuccaaggacaacucgauccgccuguccgccgggggcgacaucugggucacccgggagccguacgugucgugcgaccccgacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccucguccugccacgacggcaaggccuggcugcacgugugcaucaccggggacgacaagaacgcgaccgccagcuucaucuacaacggccggcucguggacuccguggucucgugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccgcgguaccccgggguccgcugcgugugccgggacaacuggaagggcagcaaccgccccaucguggacaucaacaucaaggaccacuccaucgucucguccuacgugugcagcggccuggugggggacacgccccggaagaacgacuccucguccucgucccacugccuggacccgaacaacgaggagggcgggcacggcgucaaggggugggccuucgacgacggcaacgacguguggaugggccgcaccaucaacgagaccagccggcucggguacgagaccuucaaggucaucgagggcugguccaaccccaagucgaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27505 - RNA, 1410 nt, Artificial Sequence; identical to SEQ ID NO: 25777
  derived and/or modified CDS sequence (AUadapt) from InfluenzaA__AHM00542__NA

SEQ ID NO: 27506 - RNA, 1410 nt, Artificial Sequence
  derived and/or modified CDS sequence (AUadapt) from InfluenzaA__AHM00546__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccucguccugccacgacgggaaggccuggcugcacgugugcaucaccggcgacgacaagaacgcgaccgccagcuucaucuacaacgggcggcucguggacuccguggucucgugguccaaggagauccugcgcacccaggagagcgagugcgugugcaucaacggcacgugcaccguggucaugaccgacggguccgccucgggcaaggccgacaccaagauccuguucaucgaggagggcaagaucgugcacacgagcacccucuccgggucggcgcagcacguggaggagugcuccugcuacccccgguacccgggcguccgcugcgugugccgggacaacuggaaggggucgaaccgccccaucguggacaucaacaucaaggaccacuccaucgucagcaaguacgugugcuccggccuggugggcgacacgccccggaagaacgacucguccagcuccucgcacugccuggaccccaacaacgaggagggcgggcacggggucaagggcugggccuucgacgacgggaacgacguguggaugggccgcaccaucaacgagaccucccggcucggcuacgagaccuucaaggucaucgagggguggucgaacccgaaguccaagcugcagaucaaccgccaggugaucguggaccggggcgaccgcagcggguacuccggcaucuucucggucgaggggaaguccugcaucaaccggugcuucuacguggagcugauccgcggccggaaggaggagaccgaggugcucuggaccagcaacucgaucgucguguucugcggcacguccgggaccuacggcaccgggagcuggcccgacggcgccgaccugaaccugaugcccaucuga

SEQ ID NO: 27507 - RNA, 1410 nt, Artificial Sequence
  derived and/or modified CDS sequence (AUadapt) from InfluenzaA__AHM00558__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggaggucugccccaagccggccgaguaccggaacuggagcaagccccagugcgggaucaccggcuucgcgcccuucuccaaggacaacucgauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccgucgugagcugguccaaggagauccugcgcacccaggagucggagugcgugugcaucaacgggacgugcaccgucgugaugaccgacggcuccgccagcggcaaggccgacaccaagauccuguucaucgaggaggggaagaucgugcacacgucgacccucuccggcucggcgcagcacgucgaggagugcuccugcuacccccgguacccgggggugcgcugcgugugccgggacaacuggaagggcagcaaccgccccaucgucgacaucaacaucaaggaccacuccaucgugucguccuacgugugcagcggccuggucggggacaccccgcggaagaacgacuccucguccagcucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggugaucgucgaccgcggggaccgguccggcuacucggggaucuucuccguggagggcaagagcugcaucaaccggugcuucuacguggagcugauccgcggccggaaggaggagaccgagguccucuggaccucgaacuccaucgugguguucugcgggacgagcggcaccuacgggaccggcuccuggcccgacggggccgaccugaaccugaugcccaucuga

SEQ ID NO: 27508 - RNA, 1410 nt, Artificial Sequence; identical to SEQ ID NO: 16339
  derived and/or modified CDS sequence (AUadapt) from InfluenzaA__AHM00570__NA

SEQ ID NO: 27509 - RNA, 1410 nt, Artificial Sequence; identical to SEQ ID NO: 16339
  derived and/or modified CDS sequence (AUadapt) from InfluenzaA__AHM00582__NA

SEQ ID NO: 27510 - RNA, 1410 nt, Artificial Sequence
  derived and/or modified CDS sequence (AUadapt) from InfluenzaA__AHM00594__NA
augaaccccaaccagaagaucaucaccaucggcucggugucccugaccaucucgacgaucugcuucuucaugcagaucgccauccucaucaccaccgucacccugcacuucaagcagcacgaguucaacuccccgcccaacaaccaggugaugcugugcgagcccacgaucaucgagcgcaacaucaccgagaucgugcaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugucgugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccucguccugccacgacggcaaggccuggcugcacgugugcaucaccggggacgacaagaacgcgaccgccagcuucaucuacaacggccggcucguggacuccguggucucgugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccucgucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagucgaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27511 - RNA, 1410 nt, Artificial Sequence; identical to SEQ ID NO: 16339
  derived and/or modified CDS sequence (AUadapt) from InfluenzaA__AHM00606__NA

SEQ ID NO: 27512 - RNA, 1410 nt, Artificial Sequence; identical to SEQ ID NO: 16339
  derived and/or modified CDS sequence (AUadapt) from InfluenzaA__AHM00618__NA

SEQ ID NO: 27513 - RNA, 1410 nt, Artificial Sequence; identical to SEQ ID NO: 16339
  derived and/or modified CDS sequence (AUadapt) from InfluenzaA__AHM00630__NA

SEQ ID NO: 27514 - RNA, 1410 nt, Artificial Sequence; identical to SEQ ID NO: 16339
  derived and/or modified CDS sequence (AUadapt) from InfluenzaA__AHM00642__NA

SEQ ID NO: 27515 - RNA, 1410 nt, Artificial Sequence; identical to SEQ ID NO: 25777
  derived and/or modified CDS sequence (AUadapt) from InfluenzaA__AHM00654__NA

SEQ ID NO: 27516 - RNA, 1410 nt, Artificial Sequence; identical to SEQ ID NO: 16339
  derived and/or modified CDS sequence (AUadapt) from InfluenzaA__AHM00666__NA

SEQ ID NO: 27517 - RNA, 1410 nt, Artificial Sequence; identical to SEQ ID NO: 27456
  derived and/or modified CDS sequence (AUadapt) from InfluenzaA__AHM00678__NA

SEQ ID NO: 27518 - RNA, 1410 nt, Artificial Sequence; identical to SEQ ID NO: 25791
  derived and/or modified CDS sequence (AUadapt) from InfluenzaA__AHM00690__NA

SEQ ID NO: 27519 - RNA, 1410 nt, Artificial Sequence; identical to SEQ ID NO: 25777
  derived and/or modified CDS sequence (AUadapt) from InfluenzaA__AHM00701__NA

SEQ ID NO: 27520 - RNA, 1410 nt, Artificial Sequence
  derived and/or modified CDS sequence (AUadapt) from InfluenzaA__AHM00713__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagagcgccgaguaccggaacugguccaagccgcagugcgggaucaccggcuucgcgcccuucucgaaggacaacuccauccgccugagcgccgggggcgacaucugggucacccgggagcccuacguguccugcgaccccgacaagugcuaccaguucgcccuggggcagggcaccacgcucaacaacgugcacucgaacaacaccguccgcgaccggaccccguaccgcacccugcugaugaacgagcucggcgugcccuuccaccuggggacgaagcaggucugcaucgccugguccagcuccucgugccacgacggcaaggccuggcugcacgugugcaucaccggggacgacaagaacgcgaccgccuccuucaucuacaacggccggcucguggacagcguggucuccuggucgaaggagauccugcgcacccaggaguccgagugcgugugcaucaacgggacgugcaccguggucaugaccgacggcagcgccucgggcaaggccgacaccaagauccuguucaucgaggaggggaagaucgugcacacguccacccucagcggcuccgcgcagcacguggaggagugcucgugcuacccccgguaccccgggguccgcugcgugugccgggacaacuggaagggcuccaaccgcccgaucguggacaucaacaucaaggaccacagcaucgucuccucguacgugugcuccggccuggugggggacacgccccggaagaacgacagcuccucguccagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggucgaaccccaaguccaagcugcagaucaaccgccaggugaucguggaccgcggggaccggagcggcuacuccgggaucuucucggucgagggcaagagcugcaucaaccggugcuucuacguggagcugauccgcggccggaaggaggagaccgaggugcucuggaccuccaacucgaucgucguguucugcgggacguccggcaccuacgggaccggcagcuggccggacggggccgaccugaaccugaugcccaucuga

SEQ ID NO: 27521 - RNA, 1410 nt, Artificial Sequence; identical to SEQ ID NO: 16339
  derived and/or modified CDS sequence (AUadapt) from InfluenzaA__AHM00725__NA

SEQ ID NO: 27522 - RNA, 1410 nt, Artificial Sequence; identical to SEQ ID NO: 16339
  derived and/or modified CDS sequence (AUadapt) from InfluenzaA__AHM00737__NA

SEQ ID NO: 27523 - RNA, 1410 nt, Artificial Sequence; identical to SEQ ID NO: 27456
  derived and/or modified CDS sequence (AUadapt) from InfluenzaA__AHM00749__NA

SEQ ID NO: 27524 - RNA, 1410 nt, Artificial Sequence; identical to SEQ ID NO: 16339
  derived and/or modified CDS sequence (AUadapt) from InfluenzaA__AHM00761__NA

SEQ ID NO: 27525 - RNA, 1410 nt, Artificial Sequence; identical to SEQ ID NO: 25777
  derived and/or modified CDS sequence (AUadapt) from InfluenzaA__AHM00785__NA

SEQ ID NO: 27526 - RNA, 1410 nt, Artificial Sequence; identical to SEQ ID NO: 25412
  derived and/or modified CDS sequence (AUadapt) from InfluenzaA__AHM00797__NA

SEQ ID NO: 27527 - RNA, 1410 nt, Artificial Sequence
  derived and/or modified CDS sequence (AUadapt) from InfluenzaA__AHM00809__NA
augaaccccaaccagaagaucaucaccaucggcucggugucccugaccaucucgacgaucugcuucuucauccagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacaugcacuccaacaacaccgugcgcgaccggacccccuaccgcacccugcugaugaacgagcucggcguccccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggugagcugguccaaggagauccugcgcacccaggagucggagugcgucugcaucaacggcacgugcaccguggugaugaccgacggguccgccagcggcaaggccgacaccaagauccuguucaucgaggagggcaagaucguccacacgucgacccucuccgggucggcgcagcacguggaggagugcuccugcuacccccgguacccgggcgugcgcugcgucugccgggacaacuggaaggggagcaaccgccccaucguggacaucaacaucaaggaccacuccaucgugucguccuacgucugcagcggccuggugggcgacaccccgcggaagaacgacuccucguccagcucccacugccuggaccccaacaacgaggagggcgggcacggggugaagggcugggccuucgacgacgggaacgacgucuggaugggccgcaccaucaacgagacgucgcggcucggcuacgagaccuucaaggugaucgaggggugguccaaccccaagagcaagcugcagaucaaccgccaggucaucguggaccggggcgaccgcuccggguacucgggcaucuucuccguggagggcaagagcugcaucaaccggugcuucuacgucgagcugauccgcgggcggaaggaggagaccgaggugcucuggaccucgaacuccaucguggucuucugcggcacgagcgggaccuacggcaccggguccuggcccgacggcgccgaccugaaccugaugcccaucuga

SEQ ID NO: 27528 - RNA, 1410 nt, Artificial Sequence; identical to SEQ ID NO: 27456
  derived and/or modified CDS sequence (AUadapt) from InfluenzaA__AHM00821__NA

SEQ ID NO: 27529 - RNA, 1410 nt, Artificial Sequence; identical to SEQ ID NO: 27456
  derived and/or modified CDS sequence (AUadapt) from InfluenzaA__AHM00833__NA

SEQ ID NO: 27530 - RNA, 1410 nt, Artificial Sequence; identical to SEQ ID NO: 25412
  derived and/or modified CDS sequence (AUadapt) from InfluenzaA__AHM00845__NA

SEQ ID NO: 27531 - RNA, 1410 nt, Artificial Sequence; identical to SEQ ID NO: 16339
  derived and/or modified CDS sequence (AUadapt) from InfluenzaA__AHM00857__NA

SEQ ID NO: 27532 - RNA, 1410 nt, Artificial Sequence; identical to SEQ ID NO: 16339
  derived and/or modified CDS sequence (AUadapt) from InfluenzaA__AHM00869__NA

SEQ ID NO: 27533 - RNA, 1410 nt, Artificial Sequence; identical to SEQ ID NO: 16339
  derived and/or modified CDS sequence (AUadapt) from InfluenzaA__AHM00881__NA

SEQ ID NO: 27534 - RNA, 1410 nt, Artificial Sequence; identical to SEQ ID NO: 25777
  derived and/or modified CDS sequence (AUadapt) from InfluenzaA__AHM00893__NA

SEQ ID NO: 27535 - RNA, 1410 nt, Artificial Sequence
  derived and/or modified CDS sequence (AUadapt) from InfluenzaA__AHM00905__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggagauccugcgcacccaggagagcgagugcgugugcaucaacgggacgugcaccguggucaugaccgacggcuccgccucgggcaaggccgacaccaagauccuguucaucgaggaggggaagaucgugcacacgagcacccucuccggcucggcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacacgccccggaagaccgacuccagcuccucgggccacugccuggaccccaacaacgaggagggcgggcacggggucaagggcugggccuucgacgacggcaacgacguguggauggggcgcaccaucaacgagaccucccggcucggcuacgagaccuucaaggucaucgagggguggucgaacccgaaguccaagcugcagaucaaccgccaggugaucguggaccggggcgaccgcagcggguacuccggcaucuucucggucgagggcaaguccugcaucaaccggugcuucuacguggagcugauccgcgggcggaaggaggagaccgaggugcucuggacgagcaacucgaucgucguguucugcggcaccuccgggaccuacggcaccgggagcuggcccgacggcgccgaccugaaccugaugcccaucuga

SEQ ID NO: 27536 - RNA, 1410 nt, Artificial Sequence
  derived and/or modified CDS sequence (AUadapt) from InfluenzaA__AHM00917__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacaucuggaugggccgcaccaucaacgagacgucgcggcucggguacgagaccuucaaggugaucgagggcugguccaaccccaagagcaagcugcagaucaaccgccaggucaucguggaccgcggggaccgguccggcuacucggggaucuucuccguggagggcaagagcugcaucaaccggugcuucuacgucgagcugauccgcggccggaaggaggagaccgaggugcucuggaccucgaacuccaucguggucuucugcgggacgagcggcaccuacgggaccggcuccuggcccgacggggccgaccugaaccugaugcccaucuga

SEQ ID NO: 27537 - RNA, 1410 nt, Artificial Sequence; identical to SEQ ID NO: 16339
  derived and/or modified CDS sequence (AUadapt) from InfluenzaA__AHM00929__NA

SEQ ID NO: 27538 - RNA, 1410 nt, Artificial Sequence
  derived and/or modified CDS sequence (AUadapt) from InfluenzaA__AHM00941__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccauccgcgaccggacccccuaccgcacccugcugaugaacgagcucggcguccccuuccaccugggcacgaagcaggucugcaucgccuggucguccucguccugccacgacgggaaggccuggcugcacgugugcaucaccggcgacgacaagaacgcgaccgccagcuucaucuacaacgggcggcucguggacuccguggugucgugguccaaggagauccugcgcacccaggagagcgagugcgucugcaucaacggcacgugcaccguggugaugaccgacggguccgccucgggcaaggccgacaccaagauccuguucaucgaggagggcaagaucguccacacgagcacccucuccgggucggcgcagcacguggaggagugcuccugcuacccccgguacccgggcgugcgcugcgucugccgggacaacuggaaggggucgaaccgccccaucguggacaucaacaucaaggaccacuccaucgugagccgguacgucugcuccggccuggugggcgacacgccccgcaagaacgacucguccagcuccucgcacugccuggaccccaacaacgaggagggcgggcacggggugaagggcugggccuucgacgacgggaacgacgucuggaugggccggaccaucaacgagaccucccgccucggcuacgagaccuucaaggugaucgagggguggucgaacccgaaguccaagcugcagaucaaccggcaggucaucguggaccgcggcgaccggagcggguacuccggcaucuucucgguggaggggaaguccugcaucaaccgcugcuucuacgucgagcugauccggggccgcaaggaggagaccgaggugcucuggaccagcaacucgaucguggucuucugcggcacguccgggaccuacggcaccgggagcuggcccgacggcgccgaccugaaccugaugcccaucuga

SEQ ID NO: 27539 - RNA, 1410 nt, Artificial Sequence
  derived and/or modified CDS sequence (AUadapt) from InfluenzaA__AHM00953__NA
augaaccccaaccagaagaucaucaccaucggcucggugucccugaccaucucgacgaucugcuucuucaugcagaucgccauccucaucaccaccgucacccugcacuucaagcaguacgccuucaacuccccgcccaacaaccaggugaugcugugcgagcccacgaucaucgagcgcaacaucaccgagaucguguaccucaccaacaccacgaucgagaaggagaucugccccaagccggcggaguaccggaacuggagcaagccccagugcgggaucaccggcuucgcccccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggcguggcugcacgugugcaucaccggggacgacaagaacgccaccgccucguucaucuacaacggccggcucguggacuccguggucagcugguccaaggagauccugcgcacccaggagucggagugcgugugcaucaacgggacgugcaccguggucaugaccgacggcuccgccagcggcaaggcggacaccaagauccuguucaucgaggaggggaagaucgugcacacgucgacccucuccggcucggcccagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27540 - RNA, 1410 nt, Artificial Sequence; identical to SEQ ID NO: 25777
  derived and/or modified CDS sequence (AUadapt) from InfluenzaA__AHM00965__NA

SEQ ID NO: 27541 - RNA, 1410 nt, Artificial Sequence; identical to SEQ ID NO: 25777
  derived and/or modified CDS sequence (AUadapt) from InfluenzaA__AHM00977__NA

SEQ ID NO: 27542 - RNA, 1398 nt, Artificial Sequence
  derived and/or modified CDS sequence (AUadapt) from InfluenzaA__AHM24226__NA
augaaucccaaccagaagauccugugcaccucggccaccgccaucaucaucggcgcgaucgccgugcucaucgggaucgccaaccugggccugaacaucgggcuccaccugaagccgggcugcaacugcucccacucgcagcccgagacgaccaacaccucccagaccaucaucaacaauuacuacaacgagacgaacaucaccaacauccagauggaggagcgcaccucgcggaacuucaacaaccugaccaaggggcucugcacgaucaacuccuggcacaucuauggcaaggacaacgccguccgcaucggcgagucguccgacgugcuggugacccgggagcccuacgucucgugcgaccccgacgagugccgcuucuacgcccugucccaggggaccaccauccggggcaagcacucgaaugggacgauccacgaccgcucccaguaccgggcgcucaucucguggccgcuguccucgccgcccaccguguacaacucccgcguggagugcaucggcuggucguccaccucgugccacgacgggaagucccggaugaguaucugcaucucgggccccaacaacaacgccuccgccgucgugugguacaaccgccggcccguggccgagaucaacaccugggcgcgcaacauccugcggacgcaggagucggagugcgucugccacaacggcgugugucccguggucuucaccgacggguccgccaccggccccgccgacacccgcaucuacuacuucaaggaggggaagaugcucaagugggagucgcugacgggcaccgccaagcacaacgaggagugcuccugcuacggcgagcggaccgggaucacgugcacgugucgcgacaacuggcagggcucgaaccggcccgugauccagaucgacccgguggccaugacccacaccucccaguacaucugcucgcccguccugaccgacaacccccgccccaacgacccgaauaucgggaagugcaacgaccccuaccccggcaacaacaacaacggggugaagggcuucuccuaccucgacggcgcgaacaccuggcuggggcggaccaucucgaccgccucccgcucgggcuaugagaugcugaaggugcccaacgcccucaccgacgaccgguccaagccgauccaggggcagacgaucguccugaacgccgacuggucgggcuacuccgggucguucauggacuacugggccgagggcgacugcuaucgcgcgugcuucuacguggagcugauccgcggccggcccaaggaggacaaggugugguggaccuccaacucgaucgucuccaugugcucgucgaccgaguuccucgggcaguggaacuggcccgacggcgccaagaucgaguacuuccuguga

SEQ ID NO: 27543 - RNA, 1398 nt, Artificial Sequence; identical to SEQ ID NO: 16294
  derived and/or modified CDS sequence (AUadapt) from InfluenzaA__AHM24238__NA

SEQ ID NO: 27544 - RNA, 1398 nt, Artificial Sequence
  derived and/or modified CDS sequence (AUadapt) from InfluenzaA__AHM24250__NA
augaaucccaaccagaagauccugugcaccucggccaccgccaucaucaucggcgcgaucgccgugcucaucgggaucgccaaccugggccugaacaucgggcuccaccugaagccguccugcaacugcucgcacucccagcccgagacgaccaacaccucgcagaccaucaucaacaacuauuacaacgagacgaacaucaccaacauccagauggaggagcgcaccucccggaacuucaacaaccugaccaagggccucugcacgaucaacucguggcacaucuacgggaaggacaacgccguccgcaucggcgagaauuccgacgugcuggugacccgggagcccuacgucucgugcgaccccgacgagugccgcuucuacgcccugucccagggcaccaccauccgggggaagcacucgaacggcacgauccacgaccgcucccaguaccgggcgcucaucaguuggccgcuguccucgccgcccaccguguacaacucccgcguggagugcaucggguggucguccaccucgugccacgacggcaagucccggaugucgaucugcaucucggggcccaacaacaacgccuccgccgucgugugguauaaccgccggcccguggccgagaucaacaccugggcgcgcaacauccugcggacgcaggagucggagugcgucugccacaacggcgugugccccguggucuucaccgacggcuccgccaccgggcccgccgacacccgcaucuacuacuucaaggagggcaagauccucaagugggagagucugacggggaccgccaagcacaucgaggagugcuccugcuacggcgagcggaccggcaucacgugcacgugccgcgacaacuggcaggggucgaaccggcccgugauccagaucgacccgguggccaugacccacaccucccaguacaucugcucgcccguccugaccgauaacccccgccccaacgacccgaacaucggcaagugcaacgaccccuaccccgggaacaacaacaacggcgugaagggguucuccuaccucgacggcgcgaauaccuggcugggccggaccaucucgaccgccucccgcucgggguacgagaugcugaaggugcccaacgcccucaccgacgaccgguccaagccgauccagggccagacgaucguccugaacgccgacuggucgggguacuccggcucguucauggacuacugggccgagggggacuguuaccgcgcgugcuucuacguggagcugauccgcggccggcccaaggaggacaaggugugguggaccuccaacucgaucgucuccaugugcucgucgaccgaguuccucggccaguggaacuggcccgacggggccaagaucgaguacuuccuguga

SEQ ID NO: 27545 - RNA, 1410 nt, Artificial Sequence; identical to SEQ ID NO: 23111
  derived and/or modified CDS sequence (AUadapt) from InfluenzaA__AHM98312__NA

SEQ ID NO: 27546 - RNA, 1410 nt, Artificial Sequence
  derived and/or modified CDS sequence (AUadapt) from InfluenzaA__AHM98331__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggucgggcuacuccgggagcuucgugcagcacccggagcugacgggccuggacugcauccgccccugcuucuggguggagcucauccggggccgccccaaggagaacaccaucuggaccuccgggagcuccaucagcuucugcggcguccacuccgacaccgugggguggagcuggcccgacggcgccgagcugccguucacgaucgacaaguga

SEQ ID NO: 27547 - RNA, 1410 nt, Artificial Sequence; identical to SEQ ID NO: 23127
  derived and/or modified CDS sequence (AUadapt) from InfluenzaA__AHM98342__NA

SEQ ID NO: 27548 - RNA, 1410 nt, Artificial Sequence
  derived and/or modified CDS sequence (AUadapt) from InfluenzaA__AHM98353__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcguggacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggucgggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 27549 - RNA, 1410 nt, Artificial Sequence
  derived and/or modified CDS sequence (AUadapt) from InfluenzaA__AHM98364__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaaccuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggucgggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 27550 - RNA, 1410 nt, Artificial Sequence
  derived and/or modified CDS sequence (AUadapt) from InfluenzaA__AHM98375__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuuccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucucgucccggaagggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 27551 - RNA, 1410 nt, Artificial Sequence; identical to SEQ ID NO: 23111
  derived and/or modified CDS sequence (AUadapt) from InfluenzaA__AHM98386__NA

SEQ ID NO: 27552 - RNA, 1410 nt, Artificial Sequence
  derived and/or modified CDS sequence (AUadapt) from InfluenzaA__AHM98408__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccuggaucaaccagaccuacgugaacaucagcaacacgaacuucgccgcgggccaguccguggucagcgugaagcuggccgggaacuccucgcucugcccgguguccggcugggccaucuacagcaaggacaacuccauccgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacucgcgguucgaguccgucgccuggagcgcguccgccugccacgacgggaucaacuggcucaccaucggcaucagcggccccgacaacggggccguggccgugcugaaguacaacggcaucaucaccgacaccaucaaguccuggcgcaacaacauccugcggacgcaggagagcgagugcgcgugcgucaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgugagcuccaacggggccaacggcgucaagggguucagcuucaaguacggcaacgggguguggaucggccgcaccaagagcaucuccucgcggaagggcuucgagaugaucugggaccccaacggguggaccggcaccgacaacuccuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 27553 - RNA, 1410 nt, Artificial Sequence; identical to SEQ ID NO: 27552
  derived and/or modified CDS sequence (AUadapt) from InfluenzaA__AHM98419__NA

SEQ ID NO: 27554 - RNA, 1410 nt, Artificial Sequence
  derived and/or modified CDS sequence (AUadapt) from InfluenzaA__AHM98430__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccagaacgucaucaccuacgagaacaacaccugggugaaccagaccuacgugaacaucuccaacacgaacuucgccgcgggccagagcgucgugccggugaagcuggccgggaacuccucgcucugccccgucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgccguaccgcacgcugauguccugccccaucggcgagguccccagccccuacaacucccgguucgagagcguggccuggagcgcguccgccugccacgacgggaucaacuggcucaccaucggcaucucgggcccggacaacggggccguggccguccugaaguacaacggcaucaucaccgacaccaucaaguccuggcgcaacaacauccugcggacgcaggagagcgagugcgcgugcgugaacggguccugcuucaccaucaugaccgacggccccagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgcccguggguguccuucaaccagaaccucgaguaccagaucggguacaucugcagcggcaucuucggggacaacccccggcccaacgacaagaccggcuccugcggccccgucagcuccaacggggccaacggcgugaagggguucucguucaaguacggcaacgggguguggaucggccgcaccaaguccaucagcagccggaagggcuucgagaugaucugggacccgaacggguggaccggcaccgacaacaacuucuccaucaagcaggacaucgucgggaucaacgaguggagcggcuacuccgggucguucgugcagcaccccgagcugacgggccuggacugcauccgccccugcuucuggguggagcucauccggggccgccccaaggagaacaccaucuggaccuccgggagcuccaucagcuucugcggcgucaacuccgacaccgugggguggagcuggccggacggcgccgagcugcccuucacgaucgacaaguga

SEQ ID NO: 27555 - RNA, 1410 nt, Artificial Sequence; identical to SEQ ID NO: 23359
  derived and/or modified CDS sequence (AUadapt) from InfluenzaA__AHM98441__NA

SEQ ID NO: 27556 - RNA, 1410 nt, Artificial Sequence
  derived and/or modified CDS sequence (AUadapt) from InfluenzaA__AHM98452__NA
augaaccccaaccagaagaucaucaccaucggcucggugugcaugaccaucgggauggccaaccugauccuccagaucggcaacaucaucuccaucuggaucagccacuccauccagcugcgcaaccagagccagaucgagacgugcaaccaguccgucaucaccuacgagaacaacaccugggugaaccagaccuacgugaacaucagcaacacgaacuucgccgcggggcaguccgucgugucggugaagcuggccggcaacuccagccucugcccggucuccgggugggccaucuacagcaaggacaacuccauccggaucggcagcaagggcgacguguucgugauccgcgagcccuucaucuccugcagcccccuggagugccggaccuucuuccugacccagggggcccuccugaacgacaagcacuccaacggcaccaucaaggaccgcucgcccuaccggacgcugauguccugcccgaucggggagguccccagccccuacaacagccgcuucgaguccguggccuggagcgcguccgccugccacgacggcaucaacuggcucaccaucgggaucagcggccccgacaacggcgccguggccguccugaaguacaacgggaucaucaccgacaccaucaaguccuggcggaacaacauccugcgcacgcaggagucggagugcgcgugcgugaacggcuccugcuucaccaucaugaccgacgggccgagcgacggccaggccuccuacaagaucuuccggaucgagaagggcaagaucgucaagagcguggagaugaacgcccccaacuaccacuacgaggagugcuccugcuaccccgacagcuccgagaucacgugcgugugccgcgacaacuggcacgggagcaaccggcccuggguguccuucaaccagaaccucgaguaccagaucggcuacaucugcucggggaucuucggcgacaacccgcgccccaacgacaagaccggguccugcggccccgucagcuccaacggcgccaacggggugaagggcuucagcuucaaguacgggaacggcguguggaucgggcggaccaagagcaucuccagccgcaagggcuucgagaugaucugggaccccaacggcuggaccgggaccgacaacaacuucuccaucaagcaggacaucgucggcgugaacgaguggucgggguacuccggcagcuucgugcagcacccggagcugacggggcuggacugcauccggcccugcuucugggucgagcucauccgcggccggcccaaggagaacaccaucuggaccuccggcagcuccaucagcuucugcggggugaacuccgacaccgucggcuggagcuggcccgacggggccgagcugccguucacgaucgacaaguga

SEQ ID NO: 27557 - RNA, 1410 nt, Artificial Sequence; identical to SEQ ID NO: 23111
  derived and/or modified CDS sequence (AUadapt) from InfluenzaA__AHM98474__NA

SEQ ID NO: 27558 - RNA, 1410 nt, Artificial Sequence
  derived and/or modified CDS sequence (AUadapt) from InfluenzaA__AHM98485__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggucgggaacuccucgcucugcccgguguccggcugggccaucuacagcaaggacaacuccauccgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacucgcgguucgaguccguggccuggagcgccuccgcgugccacgacgggaucaacuggcucaccaucggcaucagcggccccgacaacggggccgucgccgugcugaaguacaacggcaucaucaccgacaccaucaaguccuggcgcaacaacauccugcggacgcaggagagcgagugcgccugcgugaacggguccugcuucaccaucaugaccgacggcccgagcgacggccaggcguccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccucgcggaagggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 27559 - RNA, 1410 nt, Artificial Sequence
  derived and/or modified CDS sequence (AUadapt) from InfluenzaA__AHM98496__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacucgaacgggaccaucaagaaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagucguggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccucggagaucaagugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcacgaaguccaucagcucccggaagggcuucgagaugaucugggaccccaacggguggaccggcaccgacaacaacuucucgaucaagcaggacaucgucgggaucaacgagugguccggcuacagcggguccuucgugcagcacccggagcugaccggccuggacugcauccgccccugcuucuggguggagcucauccggggccgccccaaggagaacacgaucuggaccagcggguccagcaucuccuucugcggcgucaacagcgacaccguggggugguccuggcccgacggcgccgagcugccguucaccaucgacaaguga

SEQ ID NO: 27560 - RNA, 1410 nt, Artificial Sequence; identical to SEQ ID NO: 23111
  derived and/or modified CDS sequence (AUadapt) from InfluenzaA__AHM98507__NA

SEQ ID NO: 27561 - RNA, 1410 nt, Artificial Sequence
  derived and/or modified CDS sequence (AUadapt) from InfluenzaA__AHM98518__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccuggaucaaccagaccuacgugaacaucagcaacacgaacuucgccgcgggccaguccguggucucggugaagcuggccgggaacuccagccucugcccgguguccggcugggccaucuacagcaaggacaacuccauccgcaucggcagcaagggggacgucuucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgaggugcccagccccuacaacagccgguucgaguccgucgccuggagcgcguccgccugccacgacgggaucaacuggcucaccaucggcaucagcggccccgacaacggggccguggccgugcugaaguacaacggcaucaucaccgacaccaucaaguccuggcgcaacaacauccugcggacgcaggagucggagugcgcgugcgucaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgugagcuccaacggggccaacggcgucaagggguucagcuucaaguacggcaacgggguguggaucggccgcaccaagagcaucuccagccggaagggcuucgagaugaucugggaccccaacggguggaccggcaccgacaacaacuucuccaucaagcaggacaucguggggaucaacgaguggucgggcuacuccgggagcuucguccagcacccggagcugacgggccuggacugcauccgccccugcuucuggguggagcucauccggggccgccccaaggagaacaccaucuggaccuccgggagcuccaugagcuucugcggcgugaacuccgacaccgucggguggagcuggcccgacggcgccgagcugccguucacgaucgacaaguga

SEQ ID NO: 27562 - RNA, 1410 nt, Artificial Sequence; identical to SEQ ID NO: 22659
  derived and/or modified CDS sequence (AUadapt) from InfluenzaA__AHM98529__NA

SEQ ID NO: 27563 - RNA, 1410 nt, Artificial Sequence; identical to SEQ ID NO: 23403
  derived and/or modified CDS sequence (AUadapt) from InfluenzaA__AHM98540__NA

SEQ ID NO: 27564 - RNA, 1410 nt, Artificial Sequence
  derived and/or modified CDS sequence (AUadapt) from InfluenzaA__AHM98562__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaaggccggcagcugcggccccgucuccagcaacggggccaacggcgugaagggguucuccuucaaguacggcaacgggguguggaucggccgcaccaagagcaucucgucccggaagggcuucgagaugaucugggaccccaacggguggaccggcaccgacaacaacuucagcaucaagcaggacaucgucgggaucaacgagugguccggcuacagcggguccuucgugcagcacccggagcugaccggccuggacugcauccgccccugcuucuggguggagcucauccggggccgccccaaggagaacacgaucuggaccagcggguccagcaucuccuucugcggcgucaacagcuacaccguggggugguccuggcccgacggcgcggagcugccguucaccaucgacaaguga

SEQ ID NO: 27565 - RNA, 1410 nt, Artificial Sequence; identical to SEQ ID NO: 27554
  derived and/or modified CDS sequence (AUadapt) from InfluenzaA__AHM98573__NA

SEQ ID NO: 27566 - RNA, 1410 nt, Artificial Sequence
  derived and/or modified CDS sequence (AUadapt) from InfluenzaA__AHM98584__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccuggaucaaccagaccuacgugaacaucagcaacacgaacuucgccgcgggccaguccguggucagcgugaagcuggccgggaacuccucgcucugcccgguguccggcugggccaucuacagcaaggacaacuccauccgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacucgcgguucgaguccgucgccuggagcgcguccgccugccacgacgggaucaacuggcucaccaucggcaucagcggccccgacaacggggccguggccgugcugcgcuacaacggcaucaucaccgacaccaucaaguccuggcggaacaacauccugcgcacgcaggagagcgagugcgcgugcgucaacggguccugcuucaccaucaugaccgacggcccgagcgacggccaggccuccuacaagaucuuccggaucgagaaggggaagaucgucaagagcguggagaugaacgcccccaacuaccacuacgaggagugcuccugcuaccccgacucguccgagaucacgugcgugugccgcgacaacuggcacggcagcaaccggcccuggguguccuucaaccagaaccucgaguaccagaucggguacaucugcagcggcaucuucggggacaacccgcgccccaacgacaagaccggcuccugcggccccgugagcuccaacggggccaacggcgucaagggguucagcuucaaguacggcaacgggguguggaucggccggaccaagagcaucuccucgcgcaagggcuucgagaugaucugggaccccaacggguggaccggcaccgacaacuccuucagcaucaagcaggacaucguggggaucaacgagugguccggcuacagcggguccuucguccagcacccggagcugacgggccuggacugcauccggcccugcuucuggguggagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 27567 - RNA, 1410 nt, Artificial Sequence; identical to SEQ ID NO: 27554
  derived and/or modified CDS sequence (AUadapt) from InfluenzaA__AHM98595__NA

SEQ ID NO: 27568 - RNA, 1410 nt, Artificial Sequence; identical to SEQ ID NO: 23111
  derived and/or modified CDS sequence (AUadapt) from InfluenzaA__AHM98606__NA

SEQ ID NO: 27569 - RNA, 1410 nt, Artificial Sequence
  derived and/or modified CDS sequence (AUadapt) from InfluenzaA__AHM98617__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccuggaucaaccagaccuacgugaacaucagcaacacgaacuucgccgcgggccaguccguggucagcgugaagcuggccgggaacuccucgcucugcccgguguccggcugggccaucuacagcaaggacaacuccauccgcaucggcagcaagggggacgucuucgugauccgggagcccuucaucuccugcagcccccugggcugccgcaccuucuuccugacccagggggcccuccugaacgacaagcacuccaacggcaccaucaaggaccggagccccuaccgcacgcugauguccugcccgaucggggaggugcccagccccuacaacucgcgguucgaguccgucgccuggagcgcguccgccugccacgacggcaucaacuggcucaccaucggcaucagcgggcccgacaacggcgccguggccgugcugaaguacaacgggaucaucaccgacaccaucaaguccuggcgcaacaacauccugcggacgcaggagagcgagugcgcgugcgucaacggcuccugcuucaccaucaugaccgacggcccgagcgacgggcaggccuccuacaagaucuuccgcaucgagaagggcaagaucgucaagagcguggagaugaacgcccccaacuaccacuacgaggagugcuccugcuaccccgacucguccgagaucacgugcgugugccgggacaacuggcacgggagcaaccgccccuggguguccuucaaccagaaccucgaguaccagaucggcuacaucugcagcgggaucuucggcgacaacccgcggcccaacgacaagaccggcuccugcgggcccgugagcuccaacggcgccaacggggucaagggcuucagcuucaaguacgggaacggcguguggaucggccgcaccaagagcaucuccucgcggaagggguucgagaugaucugggaccccaacggcuggaccgggaccgacaacuccuucagcaucaagcaggacaucgugggcaucaacgagugguccggguacagcggcuccuucguccagcacccggagcugacgggccuggacugcauccgccccugcuucuggguggagcucauccgggggcgccccaaggagaacaccaucuggaccagcggcuccagcaucuccuucugcggggugaacagcgacaccgucggcugguccuggcccgacggcgccgagcugccguucacgaucgacaaguga

SEQ ID NO: 27570 - RNA, 1410 nt, Artificial Sequence; identical to SEQ ID NO: 27552
  derived and/or modified CDS sequence (AUadapt) from InfluenzaA__AHM98628__NA

SEQ ID NO: 27571 - RNA, 1410 nt, Artificial Sequence
  derived and/or modified CDS sequence (AUadapt) from InfluenzaA__AHM98639__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaucuacgagaacaacaccuggaucaaccagaccuacgugaacaucagcaacaccaacuucgccgcggagcaguccguggucagcgugaagcuggccggcaacuccagccucugcccgguguccgggugggccaucuacagcaaggacaacuccauccgcaucggcucgaagggcgacgucuucgugauccgggagcccuucaucuccugcagcccccuggagugccgcacguucuuccugacccagggggcccuccugaacgacaagcacuccaacggcaccaucaaggaccggagccccuaccgcacccugauguccugcccgaucggggaggugcccagccccuacaacagccgguucgaguccgucgccuggagcgcguccgccugccacgacggcaucaacuggcucacgaucgggaucagcggccccgacaacggcgccguggccgugcugaaguacaacgggaucaucaccgacaccaucaaguccuggcgcaacaacauccugcggacccaggagucggagugcgcgugcgucaacggcuccugcuucacgaucaugaccgacgggccgagcgacggccaggccuccuacaagaucuuccgcaucgagaagggcaagaucgucaagagcguggagaugaacgcccccaacuaccacuacgaggagugcuccugcuaccccgacagcuccgagaucacgugcgugugccgggacaacuggcacgggagcaaccgccccuggguguccuucaaccagaaccucgaguaccagaucggcuacaucugcagcgggaucuucggcgacaacccgcggcccaacgacaagaccggguccugcggccccgugagcuccaacggcgccaacggggucaagggcuucucguucaaguacgggaacggcguguggaucgggcgcaccaagagcaucuccagccggaagggcuucgagaugaucugggaccccaacggcuggaccgggaccgacaacuccuucagcaucaagcaggacaucgugggcaucaacgagugguccggguacagcggcuccuucguccagcacccggagcugaccgggcuggacugcauccgccccugcuucuggguggagcucauccggggccgccccaaggagaacacgaucuggaccagcggcuccagcaucuccuucugcggggugaacagcgacaccgucggcugguccuggcccgacggggccgagcugccguucaccaucgacaaguga

SEQ ID NO: 27572 - RNA, 1410 nt, Artificial Sequence; identical to SEQ ID NO: 23111
  derived and/or modified CDS sequence (AUadapt) from InfluenzaA__AHM98650__NA

SEQ ID NO: 27573 - RNA, 1410 nt, Artificial Sequence; identical to SEQ ID NO: 23111
  derived and/or modified CDS sequence (AUadapt) from InfluenzaA__AHM98661__NA

SEQ ID NO: 27574 - RNA, 1410 nt, Artificial Sequence
  derived and/or modified CDS sequence (AUadapt) from InfluenzaA__AHM98672__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccagaacgucaucaccuacgagaacaacaccugggugaaccagaccuacgugaacaucuccaacacgaacuucgccgcggagcagagcgucgugccggugaagcuggccggcaacuccucgcucugccccgucuccgggugggccaucuacagcaaggacaacuccauccgcaucggcagcaagggcgacguguucgugauccgggagcccuucaucuccugcagcccccuggagugccgcaccuucuuccugacccagggggcccuccugaacgacaagcacuccaacggcaccaucaaggaccggucgccguaccgcacgcugauguccugccccaucggggagguccccagccccuacaacucccgguucgagagcguggccuggagcgcguccgccugccacgacggcaucaacuggcucaccaucgggaucucgggcccggacaacggcgccguggccguccugaaguacaacgggaucaucaccgacaccaucaaguccuggcgcaacaacauccugcggacgcaggagagcgagugcgcgugcgugaacggcuccugcuucaccaucaugaccgacgggcccagcgacggccaggccuccuacaagaucuuccgcaucgagaagggcaagaucgucaagagcguggagaugaacgcccccaacuaccacuacgaggagugcuccugcuaccccgacucguccgagaucacgugcgugugccgggacaacuggcacgggagcaaccgcccguggguguccuucaaccagaaccucgaguaccagaucggcuacaucugcagcgggaucuucggcgacaacccccggcccaacgacaagaccggguccugcggccccgucagcuccaacggcgccaacggggugaagggcuucucguucaaguacgggaacggcguguggaucgggcgcaccaaguccaucagcagccggaagggcuucgagaugaucugggacccgaacggcuggaccgggaccgacaacaacuucuccaucaagcaggacaucgucggcaucaacgaguggagcggguacuccggcucguucgugcagcaccccgagcugacggggcuggacugcauccgccccugcuucuggguggagcucauccggggccgccccaaggagaacaccaucuggaccuccggcagcuccaucagcuucugcggggucaacuccgacaccgugggcuggagcuggccggacggggccgagcugcccuucacgaucgacaaguga

SEQ ID NO: 27575 - RNA, 1410 nt, Artificial Sequence
  derived and/or modified CDS sequence (AUadapt) from InfluenzaA__AHM98683__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgacgccggccagagcgucguguccgugcgccuggcggggaacagcucccucugcccggucucgggcugggccaucuacuccaaggacaacagcauccggaucggcuccaagggggacguguucgugauccgcgagcccuucaucagcugcagcccccuggagugccggaccuucuuccugacccagggcgcccuccugaacgacaagcacuccaacgggaccaucaaggaccgcucccccuaccggacgcugaugagcugcccgaucggcgagguccccucccccuacaacagccgcuucgagucgguggccugguccgccagcgcgugccacgacggguucaacuggcucaccaucggcaucuccggccccgacaacggggccguggccguccugaaguacaacggcaucaucaccgacaccauccggagcuggcgcaacaacauccugcggacgcaggaguccgagugcgccugcgugaacgggagcugcuucaccaucaugaccgacggcccguccgacggccaggcgagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucucgucccggaagggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 27576 - RNA, 1410 nt, Artificial Sequence; identical to SEQ ID NO: 23111
  derived and/or modified CDS sequence (AUadapt) from InfluenzaA__AHM98693__NA

SEQ ID NO: 27577 - RNA, 1410 nt, Artificial Sequence; identical to SEQ ID NO: 25560
  derived and/or modified CDS sequence (AUadapt) from InfluenzaA__AHM98704__NA

SEQ ID NO: 27578 - RNA, 1410 nt, Artificial Sequence; identical to SEQ ID NO: 25560
  derived and/or modified CDS sequence (AUadapt) from InfluenzaA__AHM98715__NA

SEQ ID NO: 27579 - RNA, 1410 nt, Artificial Sequence; identical to SEQ ID NO: 23111
  derived and/or modified CDS sequence (AUadapt) from InfluenzaA__AHM98726__NA

SEQ ID NO: 27580 - RNA, 1410 nt, Artificial Sequence
  derived and/or modified CDS sequence (AUadapt) from InfluenzaA__AHM98737__NA
augaaccccaaccagaagaucaucaccaucggcucggugugcaugaccaucgggauggccaaccugauccuccagaucggcaacaucaucuccaucuggaucagccacuccauccagcugcgcaaccagagccagaucgagacgugcaaccaguccgucaucaacuacgagaacaacaccugggugaaccagaccuacgugaacaucagcaacaccaacuucgccgcggggcaguccgucgugucggugaagcuggccggcaacuccagccucugcccggucuccgggugggccaucuacagcaaggacaacuccauccggaucggcagcaagggcgacguguucgugauccgcgagcccuucgucuccugcagcccccuggagugccggacguucuuccugacccagggggcccuccugaacgacaagcacuccaacggcaccaucaaggaccgcucgcccuaccggacccugauguccugcccgaucggggaggugcccagccccuacaacagccgcuucgaguccguggccuggagcgcguccgccugccacgacggcaucaacuggcucacgaucgggaucagcggccccgacaacggcgccgucgccgugcugaaguacaacgggaucaucaccgacaccaucaaguccuggcggaacgacauccugcgcacccaggagucggagugcgcgugcgugaacggcuccugcuucacgaucaugaccgacgggccgagcgacggccaggccuccuacaagaucuuccggaucgagaagggcaagaucgucaagagcguggagaugaacgcccccaacuaccacuacgaggagugcuccugcuaccccgacagcuccgagaucacgugcgugugccgcgacaacuggcacgggagcaaccggcccugggucuccuucaaccagaaccucgaguaccagaucggcuacaucugcucggggaucuucggcgacaacccgcgccccaacgacaagaccggguccugcggccccgugagcuccaacggcgccaacggggugaagggcuucagcuucaaguacgggaacggcgucuggaucgggcggaccaagagcaucuccagccgcaagggcuucgagaugaucugggaccccaacggcuggaccgggaccgacaacaacuucuccaucaagcaggacaucgugggcaucaacgaguggucgggguacuccggcagcuucgugcagcacccggagcugaccgggcuggacugcauccggcccugcuucugggucgagcucauccgcggccggcccaaggagaacacgaucuggaccuccggcagcuccaucagcuucugcggggugaacuccgacaccgucggcuggagcuggcccgacggggccgagcugccguucaccaucgacaaguga

SEQ ID NO: 27581 - RNA, 1410 nt, Artificial Sequence; identical to SEQ ID NO: 25560
  derived and/or modified CDS sequence (AUadapt) from InfluenzaA__AHM98748__NA

SEQ ID NO: 27582 - RNA, 1410 nt, Artificial Sequence; identical to SEQ ID NO: 25560
  derived and/or modified CDS sequence (AUadapt) from InfluenzaA__AHM98759__NA

SEQ ID NO: 27583 - RNA, 1410 nt, Artificial Sequence
  derived and/or modified CDS sequence (AUadapt) from InfluenzaA__AHM98770__NA
augaaccccaaccagaagaucaucaccaucggcucggugugcaugaccaucgggauggccaaccugauccuccagaucggcaacaucaucuccaucuggaucagccacuccauccagcugcgcaaccagagccagaucgagacgugcaaccaguccgccaucaccuacgagaacaacaccugggucaaccagaccuacgugaacaucagcaacacgaacuucgcggccgggcaguccguggucucggugaagcuggccggcaacuccagccucugcccgguguccgggugggccaucuacagcaaggacaacuccauccggaucggcagcaagggcgacgucuucgugauccgcgagcccuucaucuccugcucgccccuggagugccggaccuucuuccugacccagggggcccuccugaacgacaagcacuccaacggcaccaucaaggaccgcagccccuaccggacgcugauguccugcccgaucggggaggugcccagccccuacaacagccgcuucgaguccgucgcguggucggccuccgccugccacgacggcaucaacuggcucaccaucgggaucagcggccccgacaacggcgccguggcggugcugaaguacaacgggaucaucaccgacaccaucaaguccuggcggaacaacauccugcgcacgcaggagagcgagugcgccugcgucaacggcuccugcuucaccaucaugaccgacgggccgagcgacggccaggccuccuacaagaucuuccggaucgagaagggcaagaucgucaagucgguggagaugaacgcccccaacuaccacuacgaggagugcuccugcuaccccgacagcuccgagaucacgugcgugugccgcgacaacuggcacgggagcaaccggcccuggguguccuucaaccagaaccucgaguaccagaucggcuacaucugcagcgggaucuucggcgacaacccgcgccccaacgacaagaccggguccugcggccccgugucguccaacggcgccaacggggucaagggcuucagcuucaaguacgggaacggcguguggaucgggcggaccaagagcaucuccagccgcaagggcuucgagaugaucugggaccccaacggcuggaccgggaccgacaacaacuucuccaucaagcaggacaucgugggcaucaacgaguggucgggguacuccggcagcuucguccagcacccggagcugacggggcuggacugcauccggcccugcuucuggguggagcucauccgcggccggcccaaggagaacaccaucuggaccuccggcagcuccaucagcuucugcggggugaacuccgacaccgucggcuggagcuggcccgacggggcggagcugccguucacgaucgacaaguga

SEQ ID NO: 27584 - RNA, 1410 nt, Artificial Sequence
  derived and/or modified CDS sequence (AUadapt) from InfluenzaA__AHM98781__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccucggagaucacgugcgugugccgggacaacuggcacggcuccaaccgccccugggugagcuucaaccagaaccucgaguaccagaucggguacaucugcuccggcaucuucggggacaacccgcggcccagcgacaagaccggcuccugcggccccgucagcuccaacggggccaacggcgugaagggguucagcuucaaguacggcaacgggguguggaucggccgcaccaagagcaucuccucgcggaagggcuucgagaugaucugggaccccaacggguggaccggcaccgacaacuccuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgggaccgugggcugguccuggcccgacggcgccgagcugccguucacgaucgacaaguga

SEQ ID NO: 27585 - RNA, 1410 nt, Artificial Sequence; identical to SEQ ID NO: 23111
  derived and/or modified CDS sequence (AUadapt) from InfluenzaA__AHM98801__NA

SEQ ID NO: 27586 - RNA, 1410 nt, Artificial Sequence; identical to SEQ ID NO: 22659
  derived and/or modified CDS sequence (AUadapt) from InfluenzaA__AHM98812__NA

SEQ ID NO: 27587 - RNA, 1410 nt, Artificial Sequence
  derived and/or modified CDS sequence (AUadapt) from InfluenzaA__AHM98823__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacaucaacaucagcaacacgaacuucgccgcgggccaguccguggucucggugaagcuggccgggaacuccagccucugcccgguguccggcugggccaucuacagcaaggacaacuccauccgcaucggcagcaagggggacgucuucgugauccgggagcccuucaucuccugcagccccuccgagugccgcaccuucuuccugacccagggcgcccugcucaacgacaagcacucgaacgggaccaucaaggaccggucccccuaccgcacgcugaugagcugcccgaucggcgaggugcccagccccuacaacucccgguucgagagcgucgccugguccgcgagcgccugccacgacgggaucaacuggcugaccaucggcaucuccggccccgacaacggggccguggccgugcucaaguacaacggcaucaucaccgacaccaucaagucguggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccuggaguaccagaucggguacaucugcuccggcaucuucggggacaacccgcggcccaacgacaagaccggcagcugcggccccguguccagcaacggggccaacggcgucaagggguucagcuucaaguacggcaacgggguguggaucggccgcaccaaguccaucagcucccggaagggcuucgagaugaucugggaccccaacggguggaccggcaccgacaacaacuucucgaucaagcaggacaucguggggaucaacgagugguccggcuacagcggguccuucguccagcacccggagcucacgggccuggacugcauccgccccugcuucuggguggagcugauccggggccgccccaaggagaacaccaucuggaccagcggguccagcaucuccuucugcggcgugaacagcgacaccgucgggugguccuggcccgacggcgccgagcucccguucacgaucgacaaguga

SEQ ID NO: 27588 - RNA, 1410 nt, Artificial Sequence
  derived and/or modified CDS sequence (AUadapt) from InfluenzaA__AHM98839__NA
augaaccccaaccagaagaucaucaccaucggcucggugugcaugaccgucgggauggccaaccugauccuccagaucggcaacaucaucuccaucuggaucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugucggucaagcuggccgggaacuccagccucugcccgguguccggcugggccaucuacagcaaggacaacuccauccgcaucggcagcaagggggacguguucgucauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgaggugcccagccccuacaacagccgguucgaguccguggccuggagcgcguccgccugccacgacgggaucaacuggcucaccaucggcaucagcggccccgacaacggggccgucgccgugcugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaagggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 27589 - RNA, 1410 nt, Artificial Sequence; identical to SEQ ID NO: 22659
  derived and/or modified CDS sequence (AUadapt) from InfluenzaA__AHM98850__NA

SEQ ID NO: 27590 - RNA, 1410 nt, Artificial Sequence; identical to SEQ ID NO: 22659
  derived and/or modified CDS sequence (AUadapt) from InfluenzaA__AHM98861__NA

SEQ ID NO: 27591 - RNA, 1410 nt, Artificial Sequence
  derived and/or modified CDS sequence (AUadapt) from InfluenzaA__AHM98901__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggagcccccaccgcacgcugauguccugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccucgaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacaucgucgggaucaacgagugguccggcuacucgggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 27592 - RNA, 1410 nt, Artificial Sequence; identical to SEQ ID NO: 16285
  derived and/or modified CDS sequence (AUadapt) from InfluenzaA__AHM98912__NA

SEQ ID NO: 27593 - RNA, 1410 nt, Artificial Sequence; identical to SEQ ID NO: 16285
  derived and/or modified CDS sequence (AUadapt) from InfluenzaA__AHM98923__NA

SEQ ID NO: 27594 - RNA, 1410 nt, Artificial Sequence; identical to SEQ ID NO: 16285
  derived and/or modified CDS sequence (AUadapt) from InfluenzaA__AHM98935__NA

SEQ ID NO: 27595 - RNA, 1410 nt, Artificial Sequence; identical to SEQ ID NO: 16285
  derived and/or modified CDS sequence (AUadapt) from InfluenzaA__AHM98943__NA

SEQ ID NO: 27596 - RNA, 1410 nt, Artificial Sequence; identical to SEQ ID NO: 16285
  derived and/or modified CDS sequence (AUadapt) from InfluenzaA__AHM98954__NA

SEQ ID NO: 27597 - RNA, 1410 nt, Artificial Sequence; identical to SEQ ID NO: 16285
  derived and/or modified CDS sequence (AUadapt) from InfluenzaA__AHM98972__NA

SEQ ID NO: 27598 - RNA, 1410 nt, Artificial Sequence; identical to SEQ ID NO: 16285
  derived and/or modified CDS sequence (AUadapt) from InfluenzaA__AHM98978__NA

SEQ ID NO: 27599 - RNA, 1410 nt, Artificial Sequence; identical to SEQ ID NO: 16285
  derived and/or modified CDS sequence (AUadapt) from InfluenzaA__AHM98990__NA

SEQ ID NO: 27600 - RNA, 1410 nt, Artificial Sequence; identical to SEQ ID NO: 16285
  derived and/or modified CDS sequence (AUadapt) from InfluenzaA__AHM99000__NA

SEQ ID NO: 27601 - RNA, 1410 nt, Artificial Sequence; identical to SEQ ID NO: 16285
  derived and/or modified CDS sequence (AUadapt) from InfluenzaA__AHM99011__NA

SEQ ID NO: 27602 - RNA, 1410 nt, Artificial Sequence; identical to SEQ ID NO: 16286
  derived and/or modified CDS sequence (AUadapt) from InfluenzaA__AHM99022__NA

SEQ ID NO: 27603 - RNA, 1410 nt, Artificial Sequence; identical to SEQ ID NO: 16286
  derived and/or modified CDS sequence (AUadapt) from InfluenzaA__AHM99034__NA

SEQ ID NO: 27604 - RNA, 1410 nt, Artificial Sequence; identical to SEQ ID NO: 16286
  derived and/or modified CDS sequence (AUadapt) from InfluenzaA__AHM99046__NA

SEQ ID NO: 27605 - RNA, 1410 nt, Artificial Sequence; identical to SEQ ID NO: 16286
  derived and/or modified CDS sequence (AUadapt) from InfluenzaA__AHM99057__NA

SEQ ID NO: 27606 - RNA, 1410 nt, Artificial Sequence; identical to SEQ ID NO: 16286
  derived and/or modified CDS sequence (AUadapt) from InfluenzaA__AHM99068__NA

SEQ ID NO: 27607 - RNA, 1410 nt, Artificial Sequence; identical to SEQ ID NO: 16285
  derived and/or modified CDS sequence (AUadapt) from InfluenzaA__AHM99078__NA

SEQ ID NO: 27608 - RNA, 1410 nt, Artificial Sequence
  derived and/or modified CDS sequence (AUadapt) from InfluenzaA__AHN00720__NA
augaacaccaaccagcgcaucaucaccaucggcacgaucugccugaucguggggaucaucucgcuccugcugcagaucggcaacaucgucucccucuggaucagccacuccauccagaccgaggagaagucccaccccgaggugugcaaccagagcgugaucaccuacgagaacaacaccugggucaaccagacguacaucaacaucagcaacaccaacaucgccgccgggcagggcgugaccccgaucauccuggcggggaacuccagccugugccccaucuccggcugggccaucuacucgaaggacaacuccauccggaucggcagcaagggggacaucuucgugaugcgcgagcccuucaucuccugcagccaccucgagugccggaccuucuuccugacgcagggcgcccugcucaacgaccgccacuccaacgggaccgucaaggaccggagccccuaccgcacccugauguccugcccgaucggcgaggcccccagccccuacaacucccgguucgagagcguggccuggucggcguccgccugccacgacgggaugggcuggcugaccaucggcaucagcgggcccgacaacggcgccguggccguccucaaguacaacgggaucaucacggacaccaugaaguccuggcgcaacaagauccugcggacccaggagagcgagugcgugugcaucaacggcuccugcuucaccaucaugacggacggcccgagcaacgggcaggcguccuacaagaucuucaagauggagaagggcaagaucaucaagagcaucgagcuggacgcccccaacuaccacuacgaggagugcuccugcuaccccgacaccgggaagguggucugcgugugccgcgacaacuggcacgccagcaaccggcccuggguguccuucgaccagaaccucgacuaccagaucggcuacaucugcucgggggucuucggcgacaacccgcgcuccaacgacggcaaggggaacugcggccccgugcugagcaacggggccaacggcgugaagggguucuccuuccgguacggcaacggcgucuggaucgggcgcaccaagagcaucuccagccgguccggcuucgagaugaucugggaccccaacggguggaccgagacggacagcagcuucuccaugaagcaggacaucaucgcccugaccgacuggucgggcuacuccgggagcuucgugcagcaccccgagcucaccggcaugaacugcauccgcccgugcuucuggguggagcugauccggggccagcccaaggaguccaccaucuggacgagcggguccagcaucuccuucugcggcgucaacagcgagaccgcguccuggagcuggcccgacggggccgaccugcccuucaccaucgacaaguga

SEQ ID NO: 27609 - RNA, 1410 nt, Artificial Sequence
  derived and/or modified CDS sequence (AUadapt) from InfluenzaA__AHN00767__NA
augaacaccaaccagcgcaucaucaccaucggcacgaucugccugaucguggggaucaucucgcuccugcugcagaucggcaacaucgucucccucuggaucagccacuccauccagaccggggagaagucccaccccgaggugugcaaccagagcgugaucaccuacgagaacaacaccugggucaaccagacguacgugaacaucagcaacaccaacaucgccgccggccagggggugaccccgaucauccuggcgggcaacuccagccugugccccaucuccggcugggccaucuacucgaaggacaacuccauccggaucgggagcaagggcgacaucuucgucaugcgcgagcccuucaucuccugcagccaccucgagugccggaccuucuuccugacgcagggggcccugcucaacgaccgccacuccaacggcaccgugaaggaccggagccccuaccgcacccugauguccugcccgaucggggaggcccccagccccuacaacucccgguucgagagcguggccuggucggcguccgccugccacgacggcaugggcuggcugaccaucgggaucagcggccccgacaacggggccgucgccgugcucaaguacaacggcaucaucacggacaccaucaaguccuggcgcaacaagauccugcggacccaggagagcgagugcgugugcaucaacggcuccugcuucaccaucaugacggacgggccgagcaacggccaggcguccuacaagaucuucaagauggagaaggggaagaucaucaagagcaucgagcuggacgcccccaacuaccacuacgaggagugcuccugcuaccccgacaccggcaaggucgugugcgugugccgcgacaacuggcacgccagcaaccggcccugggucuccuucgaccagaaccucgacuaccagaucggguacaucugcucgggcguguucggcgacaacccgcgcuccaacgacgggaagggcaacugcgggcccgugcugagcaacggcgccaacggggucaagggcuucuccuuccgguacggcaacgggguguggaucggccgcaccaagagcaucuccagccgguccggguucgagaugaucugggaccccaacggcuggaccgagacggacagcagcuucuccaugaagcaggacaucaucgcccugaccgacuggucgggguacuccggcagcuucgugcagcaccccgagcucaccggcaugaacugcauccgcccgugcuucugggucgagcugauccgggggcagcccaaggaguccaccaucuggacgagcggcuccagcaucuccuucugcggggugaacagcgagaccgcguccuggagcuggcccgacggcgccgaccugcccuucaccaucgacaaguga

SEQ ID NO: 27610 - RNA, 1398 nt, Artificial Sequence
  derived and/or modified CDS sequence (AUadapt) from InfluenzaA__AHN96324__NA
augaaucccaaccagaagauccugugcaccucggccaccgccaucaucaucggcgcgaucgccgugcucaucgggaucgccaaccugggccugaacaucgggcuccaccugaagccguccugcaacugcucgcacucccagcccgagacgaccaacaccucgcagaccaucaucaacaacuacuauaacgagacgaacaucaccaacauccagauggaggagcgcaccucccggaacuucaacaaccugaccaagggccucugcacgaucaacucguggcacaucuacgggaaggacaacgccguccgcaucggcgaguccucggacgugcuggugacccgggagcccuacgucuccugugaccccgacgagugccgcuucuacgcccugucgcagggcaccaccauccgggggaagcacuccaacggcacgauccacgaccgcucgcaguaccgggcgcucaucuccuggccgcugucguccccgcccaccguguacaacucgcgcguggagugcaucgggugguccaguaccuccugccacgacggcaagucgcggaugucgaucugcaucuccgggcccaacaacaacgccucggccgucgugugguacaaccgccggcccguggccgagaucaacaccugggcgcgcaacauccugcggacgcaggaguccgagugcgucugccacaauggcgugugccccguggucuucaccgacggcucggccaccgggcccgccgacacccgcaucuacuacuucaaggagggcaagauccucaagugggagucccugacggggaccgccaagcacaucgaggagugcucgugcuacggcgagcggaccggcaucacgugcacgugccgcgacaacuggcagggguccaaucggcccguggugcagaucgacccggucgccaugacccacaccucgcaguacaucugcucccccgugcugaccgacaacccccgccccaacgacccgaacaucggcaagugcaacgaccccuaccccgggaacaacaacaauggcgugaagggguucucguaccucgacggcgcgaacaccuggcugggccggaccaucuccaccgccucgcgcuccggguacgagaugcugaagguccccaacgcccucaccgacgaccggucgaagccgauccagggccagacgaucgugcugaacgccgacugguccggguacucgggcuccuucauggacuauugggccgagggggacugcuaccgcgcgugcuucuacguggagcugauccgcggccggcccaaggaggacaaggucugguggaccucgaacuccaucgugucgaugugcucguccaccgaguuccucggccaguggaacuggcccgacggggccaagaucgaguacuuccuguga

SEQ ID NO: 27611 - RNA, 1410 nt, Artificial Sequence; identical to SEQ ID NO: 23545
  derived and/or modified CDS sequence (AUadapt) from InfluenzaA__AHN96448__NA

SEQ ID NO: 27612 - RNA, 1410 nt, Artificial Sequence; identical to SEQ ID NO: 16339
  derived and/or modified CDS sequence (AUadapt) from InfluenzaA__AHN96450__NA

SEQ ID NO: 27613 - RNA, 1410 nt, Artificial Sequence
  derived and/or modified CDS sequence (AUadapt) from InfluenzaA__AHN96451__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucauguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggugacccgggagcccuacgucagcugcgacccggacaagugcuaccaguucgcccuggggcagggcaccacgcucaacaacgugcacuccaacaacaccgugcgcgaccggacccccuaccgcacccugcugaugaacgagcucggcguccccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggugagcugguccaaggagauccugcgcacccaggagucggagugcgucugcaucaacgggacgugcaccguggugaugaccgacggcuccgccagcggcaaggccgacaccaagauccuguucaucgaggaggggaagaucguccacacgucgacccucuccggcucggcgcagcacguggaggagugcuccugcuacccccgguacccgggggugcgcugcgucugccgggacaacuggaagggcagcaaccgccccaucguggacaucaacaucaaggaccacuccaucgugucguccuacgucugcagcggccuggugggggacaccccgcggaagaacgacuccucguccagcucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggucaucguggaccgcggggaccgguccggcuacucggggaucuucuccguggagggcaagagcugcaucaaccggugcuucuacgucgagcugauccgcggccggaaggaggagaccgaggugcucuggaccucgaacuccaucguggucuucugcgggacgagcggcaccuacgggaccggcuccuggcccgacggggccgaccugaaccugaugcccaucuga

SEQ ID NO: 27614 - RNA, 1410 nt, Artificial Sequence
  derived and/or modified CDS sequence (AUadapt) from InfluenzaA__AHN96453__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucgacaacgugcacuccaacaacaccguccgcaaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggacauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccaucgagggcaagagcugcaucaaccggugcuucuacgucgagcugauccgcggccggaaggaggagaccgaggugcucuggaccucgaacuccaucguggucuucugcgggacgagcggcaccuacgggaccggcuccuggcccgacggggccgaccugaaccugaugcccaucuga

SEQ ID NO: 27615 - RNA, 1410 nt, Artificial Sequence
  derived and/or modified CDS sequence (AUadapt) from InfluenzaA__AHZ13526__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccaucaucaucgagcgcaacaugacggagaucgucuaccucaccaacaccaccaucgagaaggagaucugcccgaagcugguggaguaccggaacuggagcaagccccagugcaagaucacgggguucgcgcccuucuccaaggacaacucgauccgccuguccgccggcggggacaucugggugacccgggagcccuacgucagcugcgacccgggcaagugcuaccaguucgcccucgggcagggcaccacccugaacaacaagcacuccaacgacacgauccacgaccgcacccccuaccggacccugcucaugaacgagcugggcgugcccuuccaccuggggaccaagcaggucugcaucgccuggucguccagcuccugccacgacggcaaggccuggcuccacgugugcgugacggggcacgacaagaacgcgaccgccucguucaucuacgacggccgccugguggacuccaucgggagcugguccaagaacauccugcggacccaggagucggagugcgucugcaucaacgggaccugcacgguggugaugaccgacggcuccgccagcgaccgcgccgacaccaagauccucuucaucgaggagggcaagaucguccacaucucgccccuguccggcucggcgcagcacguggaggagugcuccugcuacccgcgguaccccggggugcgcugcgucugccgggacaacuggaagggcagcaaccgccccaucguggacaucaacgugaaggacuacuccaucgucucguccuacgugugcagcggccuggugggggacacgccccggaagaacgacggcuccucguccagcuacugccgcaacccgaacaacgagaaggggaaccacggcgucaaggggugggccuucgacgacggcaacgacguguggaugggccggaccaucggggaggagcuccgcuccggcuacgagaccuucaaggucaucgggggcuggucgacccccaacuccaagcugcagaucaaccgccaggugaucguggacagcaacaaccgguccggguacucgggcaucuucuccgucgagggcaagagcugcaucaaccggugcuucuacguggagcugauccgcgggcgggagcaggagacccgcgugugguggacgucgaacuccaucgucguguucugcggcaccagcgggaccuacggcaccggguccuggcccgacggcgccgacaucaaccucaugcccaucuga

SEQ ID NO: 27616 - RNA, 1413 nt, Artificial Sequence; identical to SEQ ID NO: 22607
  derived and/or modified CDS sequence (AUadapt) from InfluenzaA__AHZ13584__NA

SEQ ID NO: 27617 - RNA, 1410 nt, Artificial Sequence; identical to SEQ ID NO: 25324
  derived and/or modified CDS sequence (AUadapt) from InfluenzaA__AHZ35575__NA

SEQ ID NO: 27618 - RNA, 1410 nt, Artificial Sequence; identical to SEQ ID NO: 25324
  derived and/or modified CDS sequence (AUadapt) from InfluenzaA__AHZ35587__NA

SEQ ID NO: 27619 - RNA, 1410 nt, Artificial Sequence
  derived and/or modified CDS sequence (AUadapt) from InfluenzaA__AHZ35611__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcgggcacggggucaagggcugggccuucgacgacgggaacgacguguggaugggccgcaccaucaacgagacgucgcggcucggcuacgagaccuucaaggucaucgaggggugguccaaccccaagagcaagcugcagaucaaccgccaggugaucguggaccggggcgaccgcuccggguacucgggcaucuucuccgucgaggggcggagcugcaucaaccgcugcuucuacguggagcugauccggggccgcaaggaggagaccgaggugcucuggaccucgaacuccaucgucguguucugcggcacgagcgggaccuacggcaccggguccuggcccgacggcgccgaccugaaccugaugcccaucuga

SEQ ID NO: 27620 - RNA, 1410 nt, Artificial Sequence; identical to SEQ ID NO: 25324
  derived and/or modified CDS sequence (AUadapt) from InfluenzaA__AHZ35623__NA

SEQ ID NO: 27621 - RNA, 1410 nt, Artificial Sequence; identical to SEQ ID NO: 25324
  derived and/or modified CDS sequence (AUadapt) from InfluenzaA__AHZ35635__NA

SEQ ID NO: 27622 - RNA, 1410 nt, Artificial Sequence
  derived and/or modified CDS sequence (AUadapt) from InfluenzaA__AHZ35647__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggucggcgcagcacguggaggagugcuccugcuacccccgguacccggacguccgcugcgugugccgggacaacuggaagggcagcaaccgccccaucguggacaucaacaucaaggaccacuccaucgucucguccuacgugugcagcgggcuggugggcgacaccccgcggaagaacgacuccucguccagcucccacugccuggaccccaacaacgaggagggcgggcacggcgucaaggggugggccuucgacgacggcaacgacguguggauggggcgcaccaucaacgagacgucgcggcucggcuacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcgggcggaaggaggagaccgaggugcucuggaccucgaacuccaucgucguguucugcggcacgagcggcaccuacgggaccggcuccuggcccgacggggccgaccugaaccugaugcccaucuga

SEQ ID NO: 27623 - RNA, 1410 nt, Artificial Sequence; identical to SEQ ID NO: 25324
  derived and/or modified CDS sequence (AUadapt) from InfluenzaA__AHZ35659__NA

SEQ ID NO: 27624 - RNA, 1410 nt, Artificial Sequence; identical to SEQ ID NO: 25324
  derived and/or modified CDS sequence (AUadapt) from InfluenzaA__AHZ35671__NA

SEQ ID NO: 27625 - RNA, 1410 nt, Artificial Sequence; identical to SEQ ID NO: 25324
  derived and/or modified CDS sequence (AUadapt) from InfluenzaA__AHZ35683__NA

SEQ ID NO: 27626 - RNA, 1410 nt, Artificial Sequence
  derived and/or modified CDS sequence (AUadapt) from InfluenzaA__AHZ35695__NA
augaaccccaaccagaagaucaucaccaucggcucggugucccugaccaucucgacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcccgccgaguaccggaacugguccaagccccagugcgacaucaccggguucgcgcccuucagcaaggacaacuccauccgccugucggccggcggggacaucugggucacccgggagccguacguguccugcgaccccgacaagugcuaccaguucgcccugggccaggggaccacgcucaacaacgugcacagcaacaacaccguccgcgaccggacccccuaccgcacccugcugaugaacgagcucggcgugcccuuccaccugggcacgaagcaggucugcaucgccugguccucguccucgugccacgacgggaaggccuggcugcacgugugcaucaccggcgacgacaagaacgcgaccgccuccuucaucuacaacgagcggcucguggacagcguggucuccuggucgaaggagauccugcgcacccaggaguccgagugcgugugcaucaacgggacgugcaccguggucaugaccgacggcagcgccuccgggaaggccgacaccaagauccuguucaucgaggagggcaagaucgugcacacgucgacccucagcggcuccgcgcagcacguggaggagugcucgugcuacccgcgguaccccgggguccgcugcgugugccgggacaacuggaagggcuccaaccgccccaucguggacaucaacaucaaggaccacucgaucgucuccagcuacgugugcuccgggcuggugggcgacacgccccggaagaacgacucguccagcuccucgcacugccuggacccgaacaacgaggagggcgggcacggcgucaaggggugggccuucgacgacggcaacgacguguggauggggcgcaccaucaacgagaccucccggcucggcuacgagaccuucaaggucaucgagggcuggucgaaccccaaguccaagcugcagaucaaccgccaggugaucguggaccgcggggaccggagcggcuacuccgggaucuucucggucgagggcaacuccugcaucaaccggugcuucuacguggagcugauccgcgggcggaaggaggagaccgaggugcucuggaccagcaacucgaucgucguguucugcggcacguccggcaccuacgggaccggcagcuggcccgacggggccgaccugaaccugaugcccaucuga

SEQ ID NO: 27627 - RNA, 1410 nt, Artificial Sequence
  derived and/or modified CDS sequence (AUadapt) from InfluenzaA__AHZ35719__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccucguccugccacgacgggaaggccuggcugcacgugugcaucaccggcgacgacaagaacgcgaccgccagcuucaucuacaacgggcggcucguggacuccguggucucgugguccaaggagauccugcgcacccaggagagcgagugcgugugcaucaacggcacgugcaccguggucaugaccgacggguccgccucgggcaaggccgacaccaagauccuguucaucgaggagggcaagaucgugcacacgagcacccucuccgggucggcgcagcacguggaggagugcuccugcuacccccgguacccgggcguccgcugcgugugccgggacaacuggaaggggucgaaccgccccaucguggacaucaacaucaaggaccacuccaucgucagcuccuacgugugcucgggccuggugggcgacaccccgcggaagaacgacuccagcuccucgucccacugccuggaccccaacaacgaggagggcgggcacggggucaagggcugggccuucgacgacgggaacgacguguggaugggccgcaccaucaacgagacgucgcggcucggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugacccccaucuga

SEQ ID NO: 27628 - RNA, 1410 nt, Artificial Sequence; identical to SEQ ID NO: 25324
  derived and/or modified CDS sequence (AUadapt) from InfluenzaA__AHZ35731__NA

SEQ ID NO: 27629 - RNA, 1410 nt, Artificial Sequence; identical to SEQ ID NO: 25324
  derived and/or modified CDS sequence (AUadapt) from InfluenzaA__AHZ35743__NA

SEQ ID NO: 27630 - RNA, 1410 nt, Artificial Sequence; identical to SEQ ID NO: 25324
  derived and/or modified CDS sequence (AUadapt) from InfluenzaA__AHZ35755__NA

SEQ ID NO: 27631 - RNA, 1410 nt, Artificial Sequence; identical to SEQ ID NO: 25324
  derived and/or modified CDS sequence (AUadapt) from InfluenzaA__AHZ35767__NA

SEQ ID NO: 27632 - RNA, 1410 nt, Artificial Sequence; identical to SEQ ID NO: 25324
  derived and/or modified CDS sequence (AUadapt) from InfluenzaA__AHZ35779__NA

SEQ ID NO: 27633 - RNA, 1410 nt, Artificial Sequence
  derived and/or modified CDS sequence (AUadapt) from InfluenzaA__AHZ35803__NA
augaaccccaaccagaagaucaucaccaucggcucggugugcaugaccaucgggauggccaaccugaugcuccagaucggcaacaucaucuccaucuggaucagccacuccauccagcuggggaacaagaaccagaucgagacgugcaaccagagcgucaucaccuacgagaacaacaccugggugaaccagaccuacgugaacaucuccaacacgaacuucgccgcgggccagagcgucguguccgugaagaucgccgggaacucgucccugugcccggucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggucgugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccuggaguaccagaucggguacaucugcuccggcaucuucggggacaacccgcggccccacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucucgaucaagcaggacaucgucgggaugaacgagugguccggcuacagcggguccuucgugcagcacccggagcucacgggccuggacugcauccgccccugcuucuggguggagcugauccggggccgccccaaggagaacaccaucuggaccagcggguccagcaucuccuucugcggcgucaacagcgacaccguggggugguccuggcccgacggcgccgagcucccguucacgaucgacaaguga

SEQ ID NO: 27634 - RNA, 1410 nt, Artificial Sequence
  derived and/or modified CDS sequence (AUadapt) from InfluenzaA__AHZ35814__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggaccucugggucacccgggagcccuacgugucgugcgaccccgacaagugcuaccaguucgcccugggccaggggaccacgcugaacaacgugcacuccaacaacaccguccgcgaccggaccccguaccgcacccuccugaugaacgagcugggcgugcccuuccaccucggcacgaagcaggucugcaucgccuggagcuccucguccugccacgacgggaaggccuggcugcacgugugcaucaccggcgacgacaagaacgcgaccgccagcuucaucuacaacgggcggcugguggacuccguggucucgugguccaaggagauccuccgcacccaggagagcgagugcgugugcaucaacggcacgugcaccguggucaugaccgacggguccgccucgggcaaggccgacaccaagauccuguucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccucgugggcgacacgccccggaagaacgacuccucguccagcucccacugccuggaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcuccagaucaaccgccaggugaucguggaccggggcaaccgcuccggguacucgggcaucuucuccgucgagggcaagagcugcaucaaccggugcuucuacguggagcugauccgcgggcggaaggaggagaccgaggugcuguggaccucgaacuccaucgucguguucugcggcacgagcgggaccuacggcaccggguccuggccggacggcgccgaccucaaccugaugcccaucuga

SEQ ID NO: 27635 - RNA, 1410 nt, Artificial Sequence
  derived and/or modified CDS sequence (AUadapt) from InfluenzaA__AHZ35837__NA
augaaccccaaccagaagaucaucaccaucggcucggugugcaugaccaucgggauggccaaccugaugcuccagaucggcaacaucaucuccaucuggaucagccacuccauccagcuggggaacaagaaccagaucgagacgugcaaccagagcgucaucaccuacgagaacaacaccugggugaaccagaccuacgugaacaucuccaacacgaacuucgccgcgggccagagcgucguguccgugaagaucgccgggaacucgucccugugcccggucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggucgugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccuggaguaccagaucggguacaucugcuccggcaucuucggggacaacccgcggccccacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucucgaucaagcaggacaucgucgggaucaacgagugguccggcuacagcggguccuucgugcagcacccggagcucacgggccuggacugcauccgccccugcuucuggguggagcugauccggggccgccccaaggagaacaccaucuggaccagcggguccagcaucuccuucugcggcgucaacagcgacaccguggggugguccuggcccgacggcgccgagcucccguucacgaucgacaaguga

SEQ ID NO: 27636 - RNA, 1410 nt, Artificial Sequence; identical to SEQ ID NO: 27635
  derived and/or modified CDS sequence (AUadapt) from InfluenzaA__AHZ35848__NA

SEQ ID NO: 27637 - RNA, 1410 nt, Artificial Sequence; identical to SEQ ID NO: 27635
  derived and/or modified CDS sequence (AUadapt) from InfluenzaA__AHZ35859__NA

SEQ ID NO: 27638 - RNA, 1410 nt, Artificial Sequence; identical to SEQ ID NO: 27634
  derived and/or modified CDS sequence (AUadapt) from InfluenzaA__AHZ35870__NA

SEQ ID NO: 27639 - RNA, 1410 nt, Artificial Sequence; identical to SEQ ID NO: 27634
  derived and/or modified CDS sequence (AUadapt) from InfluenzaA__AHZ35882__NA

SEQ ID NO: 27640 - RNA, 1410 nt, Artificial Sequence
  derived and/or modified CDS sequence (AUadapt) from InfluenzaA__AHZ35894__NA
augaaccccaaccagaagaucaucaccaucggcucggugugcaugaccaucgggauggccaaccugaugcuccagaucggcaacaucaucuccaucuggaucagccacuccauccagcuggggaacaagaaccagaucgagacgugcaaccagagcgucaucaccuacgagaacaacaccugggugaaccagaccuacgugaacaucuccaacacgaacuucgccgcgggccagagcgucguguccgugaagaucgccgggaacucgucccugugcccggucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggucgugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggccccacgacaagaccggcucgugcggccccgucuccagcaacggggccaacggcgugaagggguucuccuucaaguacggcagcgggguguggaucggccgcaccaagagcaucuccagccggaagggcuucgagaugaucugggaccccaacggguggaccggcaccgacaacaacuucuccaucaagcaggacaucgucgggaucaacgaguggucgggcuacuccgggagcuucgugcagcacccggagcucacgggccuggacugcauccgccccugcuucuggguggagcugauccggggccgccccaaggagaacaccaucuggaccuccgggagcuccaucagcuucugcggcgucaacuccgacaccgugggguggagcuggcccgacggcgccgagcucccguucacgaucgacaaguga

SEQ ID NO: 27641 - RNA, 1410 nt, Artificial Sequence; identical to SEQ ID NO: 27635
  derived and/or modified CDS sequence (AUadapt) from InfluenzaA__AHZ35905__NA

SEQ ID NO: 27642 - RNA, 1410 nt, Artificial Sequence; identical to SEQ ID NO: 27635
  derived and/or modified CDS sequence (AUadapt) from InfluenzaA__AHZ35916__NA

SEQ ID NO: 27643 - RNA, 1410 nt, Artificial Sequence; identical to SEQ ID NO: 23360
  derived and/or modified CDS sequence (AUadapt) from InfluenzaA__AHZ35927__NA

SEQ ID NO: 27644 - RNA, 1410 nt, Artificial Sequence
  derived and/or modified CDS sequence (AUadapt) from InfluenzaA__AHZ35938__NA
augaaccccaaccagaagaucaucaccaucggcucggugugcaugaucaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagucgguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacgaucaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggccccacgacaagaccggcagcugcggccccgucuccagcaacggggccaacggcgugaagggguucuccuucaaguacggcaacgggguguggaucggccgcaccaagagcaucucgucccggaagggcuucgagaugaucugggaccccaacggguggaccggcaccgacaacaacuucagcaucaagcaggacaucgucgggaucaacgagugguccggcuacagcggguccuucgugcagcacccggagcugaccggccuggacugcauccgccccugcuucuggguggagcucauccggggccgccccaaggagaacacgaucuggaccagcggguccagcaucuccuucugcggcgucaacagcgacaccguggggugguccuggcccgacggcgccgagcugccguucaccaucgacaaguga

SEQ ID NO: 27645 - RNA, 1410 nt, Artificial Sequence; identical to SEQ ID NO: 27634
  derived and/or modified CDS sequence (AUadapt) from InfluenzaA__AHZ35949__NA

SEQ ID NO: 27646 - RNA, 1410 nt, Artificial Sequence
  derived and/or modified CDS sequence (AUadapt) from InfluenzaA__AHZ35961__NA
augaaccccaaccagaagaucaucaccaucggcucggugugcaugaccaucgggauggccaaccugaugcuccagaucggcaacaucaucuccaucuggaucagccacuccauccagcuggggaacaagaaccagaucgagacgugcaaccagagcgucaucaccuacgagaacaacaccugggugaaccagaccuacgugaacaucuccaacacgaacuucgccgcgggccagagcgucguguccgugaagaucgccgggaacucgucccugugcccggucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggucgugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggccccacgacaagaccggcucgugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacaucgucgggaucaacgagugguccggcuacucgggguccuucgugcagcacccggagcucacgggccuggacugcauccgccccugcuucuggguggagcugauccggggccgccccaaggagagcaccaucuggaccuccgggagcuccaucagcuucugcggcgucaacuccgacaccgugggguggagcuggcccgacggcgccgagcucccguucacgaucgacaaguga

SEQ ID NO: 27647 - RNA, 1410 nt, Artificial Sequence; identical to SEQ ID NO: 27635
  derived and/or modified CDS sequence (AUadapt) from InfluenzaA__AHZ35972__NA

SEQ ID NO: 27648 - RNA, 1410 nt, Artificial Sequence
  derived and/or modified CDS sequence (AUadapt) from InfluenzaA__AHZ35983__NA
augaaccccaaccagaagaucaccaccaucggcucggugugcaugacgaucgggauggccaaccugaugcuccagaucggcaacaucaucuccaucuggaucagccacuccauccagcuggggaacaagaaccagaucgagaccugcaaccagagcgucaucaccuacgagaacaacaccugggugaaccagacguacgugaacaucuccaacaccaacuucgccgcgggccagagcgucguguccgugaagaucgccgggaacucgucccugugcccggucagcggcugggccaucuacuccaaggacaacagcauccgcaucggcuccaagggggacguguucgugauccgggagcccuucaucagcugcucgccccucgagugccgcaccuucuuccugacccagggcgcccugcucaacgacaagcacuccaacgggacgaucaaggaccggucccccuaccgcacccugaugagcugcccgaucggcgagguccccucccccuacaacagccgguucgagagcguggccugguccgcgucggccugccacgacgggaucaacuggcugaccaucggcaucuccggccccgacaacggggccguggccguccucaaguacaacggcaucaucaccgacacgaucaagagcuggcgcaacaacauccugcggacccaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggccccacgacaagaccggcagcugcggccccgucuccucgaacggggccaacggcgugaagggguucuccuucaaguacggcaacgggguguggaucggccgcaccaagagcaucagcucccggaagggcuucgagaugaucugggaccccaacggguggaccggcacggacaacaacuucagcaucaagcaggacaucgucgggaucaacgagugguccggcuacucgggguccuucgugcagcacccggagcucaccggccuggacugcauccgccccugcuucuggguggagcugauccggggccgccccaaggagaacaccaucuggaccagcggguccagcaucuccuucugcggcgucaacagcgacacgguggggugguccuggcccgacggcgccgagcucccguucaccaucgacaaguga

SEQ ID NO: 27649 - RNA, 1410 nt, Artificial Sequence; identical to SEQ ID NO: 27635
  derived and/or modified CDS sequence (AUadapt) from InfluenzaA__AHZ35994__NA

SEQ ID NO: 27650 - RNA, 1410 nt, Artificial Sequence; identical to SEQ ID NO: 27635
  derived and/or modified CDS sequence (AUadapt) from InfluenzaA__AHZ36005__NA

SEQ ID NO: 27651 - RNA, 1410 nt, Artificial Sequence; identical to SEQ ID NO: 27635
  derived and/or modified CDS sequence (AUadapt) from InfluenzaA__AHZ36016__NA

SEQ ID NO: 27652 - RNA, 1410 nt, Artificial Sequence
  derived and/or modified CDS sequence (AUadapt) from InfluenzaA__AHZ36027__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaucuacgagaacaacaccugggugaaccagaccuacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucucgugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggccugguccgcgagcgccugccacgacggguucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggucgugcuucacgaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagucgaucagcucccggaagggcuucgagaugaucugggaccccaacggguggaccggcaccgacaacaacuucagcaucaagcaggacaucaucgggaucaacgagugguccggcuacagcggguccuucguccagcacccggagcugaccggccuggacugcauccgccccugcuucuggguggagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 27653 - RNA, 1410 nt, Artificial Sequence
  derived and/or modified CDS sequence (AUadapt) from InfluenzaA__AHZ36050__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggcgcaacgacuccucguccagcucccacugccucgaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcugcagaucaaccgccaggugaucguggaccggggcaaccgguccggguacucgggcaucuucuccgucgagggcaagagcugcaucaaccgcugcuucuacguggagcucauccgggggcgcaaggaggagaccgaggugcuguggaccucgaacuccaucgucguguucugcggcacgagcgggaccuacggcaccggguccuggccggacggcgccgaccugaaccucaugcccaucuga

SEQ ID NO: 27654 - RNA, 1410 nt, Artificial Sequence
  derived and/or modified CDS sequence (AUadapt) from InfluenzaA__AHZ36062__NA
augaaccccaaccagaagaucaucaccaucggcucggugugcaugaccaucgggauggccaaccugaugcuccagaucggcaacaucaucuccaucuggaucagccacuccauccagcuggggaacaagaaccagaucgagacgugcaaccagagcgucaucaccuacgagaacaacaccugggugaaccagaccuacgugaacaucuccaacacgaacuucgccgcgggccagagcgucguguccgugaagaucgccgggaacucgucccugugcccggucagcggcugggccaucuacuccaaggacaacagcauccgcaucggcuccaagggggacguguucgugauccgggagcccuucaucagcugcagcccccucggcugccgcaccuucuuccugacccagggggcccugcucaacgacaagcacuccaacggcaccaucaaggaccggucccccuaccgcacgcugaugucgugcccgaucggggagguccccucccccuacaacagccgguucgagagcguggccugguccgcgagcgccugccacgacggcaucaacuggcugaccaucggcaucuccgggcccgacaacggcgccguggccguccucaaguacaacgggaucaucaccgacaccaucaagagcuggcgcaacaacauccugcggacgcaggaguccgagugcgcgugcgugaacggcucgugcuucaccaucaugaccgacggcccguccgacgggcaggccagcuacaagaucuuccgcaucgagaagggcaagaucgugaaguccgucgagaugaacgcccccaacuaccacuacgaggagugcagcugcuaccccgacuccagcgagaucacgugcgugugccgggacaacuggcacggguccaaccgccccugggugucguucaaccagaaccuggaguaccagaucggcuacaucugcuccgggaucuucggcgacaacccgcggccccacgacaagaccggcagcugcgggcccgucuccagcaacggcgccaacggggugaagggcuucuccuucaaguacgggaacggcguguggaucggccgcaccaagagcaucagcucccggaagggguucgagaugaucugggaccccaacggcuggaccgggaccgacaacaacuucucgaucaagcaggacaucgucggcaucaacgagugguccggguacagcggcuccuucgugcagcacccggagcucacgggccuggacugcauccgccccugcuucuggguggagcugauccgggggcgccccaaggagaacaccaucuggaccagcggcuccagcaucuccuucugcggggucaacagcgacaccgugggcugguccuggcccgacggcgccgagcucccguucacgaucgacaaguga

SEQ ID NO: 27655 - RNA, 1410 nt, Artificial Sequence; identical to SEQ ID NO: 27635
  derived and/or modified CDS sequence (AUadapt) from InfluenzaA__AHZ36084__NA

SEQ ID NO: 27656 - RNA, 1410 nt, Artificial Sequence
  derived and/or modified CDS sequence (AUadapt) from InfluenzaA__AHZ36095__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaucuacgagaacaacaccugggugaaccagaccuacgugaacaucuccaacaccaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagucgguggccugguccgcgagcgccugccacgacggguucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacgaucaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcggcugcgggcccgucagcuccaacggcgccaacggggugaagggcuucagcuucaaguacgggaacggcguguggaucggccgcaccaaguccaucagcucgcggaagggguucgagaugaucugggaccccaacggcuggaccgggaccgacaacaacuucuccaucaagcaggacaucaucggcaucaacgaguggagcggguacuccggcagcuucguccagcacccggagcugaccggccuggacugcauccgccccugcuucuggguggagcucauccgggggcgccccaaggagaacacgaucuggaccuccggcagcuccaucagcuucugcggggugaacuccgacaccgucggcuggagcuggcccgacggcgccgagcugccguucaccaucgacaaguga

SEQ ID NO: 27657 - RNA, 1410 nt, Artificial Sequence; identical to SEQ ID NO: 27635
  derived and/or modified CDS sequence (AUadapt) from InfluenzaA__AHZ36106__NA

SEQ ID NO: 27658 - RNA, 1410 nt, Artificial Sequence
  derived and/or modified CDS sequence (AUadapt) from InfluenzaA__AHZ36117__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaucuacgagaacaacaccugggugaaccagaccuacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucucgugcagcccccuggagugccgcacguucuuccugacccagggcgcccuccugaacgacaagcacagcaacgggaccaucaaggaccggucccccuaccgcacccugaugagcugcuccaucggcgaggucccgagccccuacaacagccgguucgaguccguggccuggagcgcguccgccugccacgacggguucaacuggcucacgaucggcaucucgggccccgacaacggggccguggccguccugaaguacaacggcaucaucaccgacaccaucaaguccuggcgcaacaacauccugcggacccaggagagcgagugcgcgugcgugaacggguccugcuucacgaucaugaccgacggccccagcgacggccaggccuccuacaagaucuuccgcaucgagaaggggaagaucgugaaguccgucgagaugaacgccccgaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccccggccgaacgacaagaccggcuccugcggccccgucagcuccaacggggccaacggcgugaagggguucucguucaaguacggcaacgggguguggaucggccgcaccaagagcaucuccagccggaagggcuucgagaugaucugggaccccaacggguggaccggcaccgacaacaacuucuccaucaagcaggacaucaucgggaucaacgaguggagcggcuacuccgggagcuucguccagcaccccgagcugaccggccuggacugcauccgcccgugcuucuggguggagcucauccggggccgccccaaggagaacacgaucuggaccuccgggagcuccaucagcuucugcggcgugaacuccgacaccgucggguggagcuggcccgacggcgccgagcugcccuucaccaucgacaaguga

SEQ ID NO: 27659 - RNA, 1410 nt, Artificial Sequence; identical to SEQ ID NO: 27635
  derived and/or modified CDS sequence (AUadapt) from InfluenzaA__AHZ36128__NA

SEQ ID NO: 27660 - RNA, 1410 nt, Artificial Sequence; identical to SEQ ID NO: 27635
  derived and/or modified CDS sequence (AUadapt) from InfluenzaA__AHZ36139__NA

SEQ ID NO: 27661 - RNA, 1410 nt, Artificial Sequence; identical to SEQ ID NO: 27653
  derived and/or modified CDS sequence (AUadapt) from InfluenzaA__AHZ36150__NA

SEQ ID NO: 27662 - RNA, 1410 nt, Artificial Sequence; identical to SEQ ID NO: 27635
  derived and/or modified CDS sequence (AUadapt) from InfluenzaA__AHZ36161__NA

SEQ ID NO: 27663 - RNA, 1410 nt, Artificial Sequence; identical to SEQ ID NO: 27635
  derived and/or modified CDS sequence (AUadapt) from InfluenzaA__AHZ36172__NA

SEQ ID NO: 27664 - RNA, 1410 nt, Artificial Sequence
  derived and/or modified CDS sequence (AUadapt) from InfluenzaA__AHZ36183__NA
augaaccccaaccagaagaucaucaccaucggcucggugugcaugaccaucgggauggccaaccugaugcuccagaucggcaacaucaucuccaucuggaucagccacuccauccagcuggggaacaagaaccagaucgagacgugcaaccagagcgucaucaccuacgagaacaacaccugggugaaccagaccuacgugaacaucuccaacacgaacuucgccgcgggccagagcgucguguccgugaagaucgccgggaacucgucccugugcccggucagcggcugggccaucuacuccaaggacaacagcauccgcaucggcuccaagggggacguguucgugauccgggagcccuucaucagcugcucgccccucgagugccgcaccuucuuccugacccagggcgcccugcucaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccuggaguaccagaucggguacaucugcuccggcauccucggggacaacccgcggccccacgacaagaccggcagcugcggccccgucuccucgaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacaucgucgggaucaacgagugguccggcuacucgggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 27665 - RNA, 1410 nt, Artificial Sequence; identical to SEQ ID NO: 27634
  derived and/or modified CDS sequence (AUadapt) from InfluenzaA__AHZ36194__NA

SEQ ID NO: 27666 - RNA, 1410 nt, Artificial Sequence; identical to SEQ ID NO: 27653
  derived and/or modified CDS sequence (AUadapt) from InfluenzaA__AHZ36206__NA

SEQ ID NO: 27667 - RNA, 1410 nt, Artificial Sequence; identical to SEQ ID NO: 27635
  derived and/or modified CDS sequence (AUadapt) from InfluenzaA__AHZ36218__NA

SEQ ID NO: 27668 - RNA, 1410 nt, Artificial Sequence; identical to SEQ ID NO: 27653
  derived and/or modified CDS sequence (AUadapt) from InfluenzaA__AHZ36229__NA

SEQ ID NO: 27669 - RNA, 1410 nt, Artificial Sequence; identical to SEQ ID NO: 27635
  derived and/or modified CDS sequence (AUadapt) from InfluenzaA__AHZ36241__NA

SEQ ID NO: 27670 - RNA, 1410 nt, Artificial Sequence; identical to SEQ ID NO: 27635
  derived and/or modified CDS sequence (AUadapt) from InfluenzaA__AHZ36252__NA

SEQ ID NO: 27671 - RNA, 1410 nt, Artificial Sequence; identical to SEQ ID NO: 27635
  derived and/or modified CDS sequence (AUadapt) from InfluenzaA__AHZ36263__NA

SEQ ID NO: 27672 - RNA, 1410 nt, Artificial Sequence; identical to SEQ ID NO: 25324
  derived and/or modified CDS sequence (AUadapt) from InfluenzaA__AHZ36274__NA

SEQ ID NO: 27673 - RNA, 1410 nt, Artificial Sequence; identical to SEQ ID NO: 27635
  derived and/or modified CDS sequence (AUadapt) from InfluenzaA__AHZ36286__NA

SEQ ID NO: 27674 - RNA, 1410 nt, Artificial Sequence
  derived and/or modified CDS sequence (AUadapt) from InfluenzaA__AHZ36297__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugcccccggccggccgaguaccgcaacuggagcaagccccagugcgacaucaccggguucgcgcccuucuccaaggacaacucgauccggcuguccgccggcggggacaucugggucacccgcgagcccuacgugagcugcgacccggacaagugcuaccaguucgcccugggccaggggaccacgcucaacaacgugcacuccaacaacaccguccgggaccgcacccccuaccggacccugcugaugaacgagcucggcgugcccuuccaccugggcacgaagcaggucugcaucgccuggucguccucguccugccacgacgggaaggccuggcugcacgugugcaucaccggcgacgacaagaacgcgaccgccagcuucaucuacaacgggcgccucguggacuccguggucucgugguccaaggagauccugcggacccaggagagcgagugcgugugcaucaacggcacgugcaccguggucaugaccgacggguccgccucgggcaaggccgacaccaagauccuguucaucgaggagggcaagaucgugcacacgagcacccucuccgggggcgcgcagcacguggaggagugcucgugcuacccccgcuacccggggguccggugcgugugccgcgacaacuggaagggcuccaaccggcccaucguggacaucaacaucaaggaccacucgaucgucuccagcuacgugugcuccggccuggugggggacacgccccgcaagaacgacucguccagcuccucgcacugccuggaccccaacaacgaggagggcgggcacggcgucaaggggugggccuucgacgacggcaacgacguguggaugggccggaccaucaacgagaccucccgccucggguacgagaccuucaaggucaucgagggcuggucgaacccgaaguccaagcugcagaucaaccggcaggucaucguggaccgcggggaccggagcggcuacuccgggaucuucucgguggagggcaaguccugcaucaaccgcugcuucuacguggagcugauccggggccgcaaggaggagaccgaggugcucuggaccagcaacucgaucgucguguucugcgggacguccggcaccuacgggaccggcagcuggcccgacggggccgaccugaaccugaugcccaucuga

SEQ ID NO: 27675 - RNA, 1410 nt, Artificial Sequence
  derived and/or modified CDS sequence (AUadapt) from InfluenzaA__AHZ36309__NA
augaaccccaaccagaagaucaucaccaucggcucggugugcaugaccaucgggauggccaaccugaugcuccagaucggcaacaucaucuccaucuggaucagccacuccauccagcugggggacaagaaccagaucgagacgugcaaccagagcgucaucaccuacgagaacaacaccugggugaaccagaccuacgugaacaucuccaacacgaacuucgccgcgggccagagcgucguguccgugaagaucgccgggaacucgucccugugcccggucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggucgugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccuggaguaccagaucggguacaucugcuccggcaucuucggggacaacccgcggccccacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucucgaucaagcaggacaucgucgggaucaacgagugguccggcuacagcggguccuucgugcagcacccggagcucacgggccuggacugcauccgccccugcuucuggguggagcugauccggggccgccccaaggagaacaccaucuggaccagcggguccagcaucuccuucugcggcgucaacagcgacaccguggggugguccuggcccgacggcgccgagcucccguucacgaucgacaaguga

SEQ ID NO: 27676 - RNA, 1410 nt, Artificial Sequence; identical to SEQ ID NO: 27635
  derived and/or modified CDS sequence (AUadapt) from InfluenzaA__AHZ36320__NA

SEQ ID NO: 27677 - RNA, 1410 nt, Artificial Sequence; identical to SEQ ID NO: 27635
  derived and/or modified CDS sequence (AUadapt) from InfluenzaA__AHZ36331__NA

SEQ ID NO: 27678 - RNA, 1410 nt, Artificial Sequence; identical to SEQ ID NO: 25324
  derived and/or modified CDS sequence (AUadapt) from InfluenzaA__AHZ36353__NA

SEQ ID NO: 27679 - RNA, 1410 nt, Artificial Sequence
  derived and/or modified CDS sequence (AUadapt) from InfluenzaA__AHZ36365__NA
augaaccccaaccagaagaucaucaccaucggcucggugugcaugaccaucgggauggccaaccugaugcuccagaucggcaacaucaucuccaucuggaucagccacccgauccagcuggggaacaagaaccagaucgagacgugcaaccaguccgucaucaccuacgagaacaacaccugggugaaccagaccuacgugaacaucagcaacacgaacuucgccgcgggccaguccgucgugagcgugaagaucgccgggaacuccucgcugugccccgucuccggcugggccaucuacagcaaggacaacuccauccgcaucggcagcaagggggacguguucgugauccgggagcccuucaucuccugcagcccccucgagugccgcaccuucuuccugacccagggcgcccugcucaacgacaagcacuccaacgggaccaucaaggaccggucgccguaccgcacgcugauguccugccccaucggcgagguccccagccccuacaacucccgguucgagagcguggccuggagcgcguccgccugccacgacgggaucaacuggcugaccaucggcaucucgggcccggacaacggggccguggccguccucaaguacaacggcaucaucaccgacaccaucaaguccuggcgcaacaacauccugcggacgcaggagagcgagugcgcgugcgugaacggguccugcuucaccaucaugaccgacggccccagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgcccguggguguccuucaaccagaaccuggaguaccagaucggguacaucugcagcggcaucuucggggacaacccccggccccacgacaagaccggcuccugcggccccgucagcuccaacggggccaacggcgugaagggguucucguucaaguacggcaacgggguguggaucggccgcaccaaguccaucagcagccggaagggcuucgagaugaucugggacccgaacggguggaccggcaccgacaacaacuucuccaucaagcaggacaucgucgggaucaacgaguggagcggcuacuccgggucguucgugcagcaccccgagcucacgggccuggacugcauccgccccugcuucuggguggagcugauccggggccgccccaaggagaacaccaucuggaccuccgggagcuccaucagcuucugcggcgucaacuccgacaccgugggguggagcuggccggacggcgccgagcuccccuucacgaucgacaaguga

SEQ ID NO: 27680 - RNA, 1410 nt, Artificial Sequence; identical to SEQ ID NO: 25324
  derived and/or modified CDS sequence (AUadapt) from InfluenzaA__AHZ36376__NA

SEQ ID NO: 27681 - RNA, 1410 nt, Artificial Sequence; identical to SEQ ID NO: 25324
  derived and/or modified CDS sequence (AUadapt) from InfluenzaA__AHZ36388__NA

SEQ ID NO: 27682 - RNA, 1410 nt, Artificial Sequence; identical to SEQ ID NO: 25324
  derived and/or modified CDS sequence (AUadapt) from InfluenzaA__AHZ36400__NA

SEQ ID NO: 27683 - RNA, 1410 nt, Artificial Sequence; identical to SEQ ID NO: 25324
  derived and/or modified CDS sequence (AUadapt) from InfluenzaA__AHZ36412__NA

SEQ ID NO: 27684 - RNA, 1410 nt, Artificial Sequence; identical to SEQ ID NO: 25324
  derived and/or modified CDS sequence (AUadapt) from InfluenzaA__AHZ36424__NA

SEQ ID NO: 27685 - RNA, 1410 nt, Artificial Sequence; identical to SEQ ID NO: 25324
  derived and/or modified CDS sequence (AUadapt) from InfluenzaA__AHZ36436__NA

SEQ ID NO: 27686 - RNA, 1410 nt, Artificial Sequence
  derived and/or modified CDS sequence (AUadapt) from InfluenzaA__AHZ36448__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagaagaacaucaccgagaucguguaccucaccaacaccacgaucgagaaggagaucugccccaagccggccgaguaccgcaacuggagcaagccccagugcgacaucaccggguucgcgcccuucuccaaggacaacucgauccggcuguccgccggcggggacaucugggucacccgcgagcccuacgugagcugcgacccggacaagugcuaccaguucgcccugggccaggggaccacgcucaacaacgugcacuccaacaacaccguccgggaccgcacccccuaccggacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcgccucguggacuccguggucagcugguccaaggagauccugcggacccaggagucggagugcgugugcaucaacggcacgugcaccguggucaugaccgacggguccgccagcggcaaggccgacaccaagauccuguucaucgaggagggcaagaucgugcacacgucgacccucuccgggucggcgcagcacguggaggagugcuccugcuacccccgcuacccgggcguccggugcgugugccgcgacaacuggaaggggagcaaccggcccaucguggacaucaacaucaaggaccacuccaucgucucguccuacgugugcagcggccuggugggcgacaccccgcgcaagaacgacuccucguccagcucccacugccuggaccccaacaacgaggagggcgggcacggggucaagggcugggccuucgacgacgggaacgacguguggaugggccggaccaucaacgagacgucgcgccucggcuacgagaccuucaaggucaucgaggggugguccaaccccaagagcaagcugcagaucaaccgccaggugaucguggaccggggcgaccgguccggguacucgggcaucuucuccgucgagggcaagagcugcaucaaccgcugcuucuacguggagcugauccgggggcgcaaggaggagaccgaggugcucuggaccucgaacuccaucgucguguucugcggcacgagcgggaccuacggcaccggguccuggcccgacggcgccgaccugaaccugaugcccaucuga

SEQ ID NO: 27687 - RNA, 1410 nt, Artificial Sequence; identical to SEQ ID NO: 25324
  derived and/or modified CDS sequence (AUadapt) from InfluenzaA__AHZ36460__NA

SEQ ID NO: 27688 - RNA, 1410 nt, Artificial Sequence; identical to SEQ ID NO: 25324
  derived and/or modified CDS sequence (AUadapt) from InfluenzaA__AHZ36472__NA

SEQ ID NO: 27689 - RNA, 1410 nt, Artificial Sequence; identical to SEQ ID NO: 25324
  derived and/or modified CDS sequence (AUadapt) from InfluenzaA__AHZ36484__NA

SEQ ID NO: 27690 - RNA, 1410 nt, Artificial Sequence; identical to SEQ ID NO: 25324
  derived and/or modified CDS sequence (AUadapt) from InfluenzaA__AHZ36496__NA

SEQ ID NO: 27691 - RNA, 1410 nt, Artificial Sequence; identical to SEQ ID NO: 25324
  derived and/or modified CDS sequence (AUadapt) from InfluenzaA__AHZ36508__NA

SEQ ID NO: 27692 - RNA, 1410 nt, Artificial Sequence; identical to SEQ ID NO: 25324
  derived and/or modified CDS sequence (AUadapt) from InfluenzaA__AHZ36520__NA

SEQ ID NO: 27693 - RNA, 1410 nt, Artificial Sequence
  derived and/or modified CDS sequence (AUadapt) from InfluenzaA__AHZ36532__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaccuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggacgacccucaacaacgugcacuccaacaacaccguccgcgaccggacccccuaccgcacgcugcugaugaacgagcucggcgugcccuuccaccugggcaccaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacgcaggagucggagugcgugugcaucaacgggaccugcaccguggucaugaccgacggguccgccagcggcaaggccgacacgaagauccuguucaucgaggagggcaagaucgugcacaccucgacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcggccacggggucaagggcugggccuucgacgacgggaacgacguguggaugggccgcacgaucaacgagaccucgcggcucggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggacgucgaacuccaucgucguguucugcggcaccagcgggaccuacggcaccggguccuggcccgacggcgccgaccugaaccugaugcccaucuga

SEQ ID NO: 27694 - RNA, 1410 nt, Artificial Sequence; identical to SEQ ID NO: 25324
  derived and/or modified CDS sequence (AUadapt) from InfluenzaA__AHZ36544__NA

SEQ ID NO: 27695 - RNA, 1410 nt, Artificial Sequence; identical to SEQ ID NO: 25324
  derived and/or modified CDS sequence (AUadapt) from InfluenzaA__AHZ36556__NA

SEQ ID NO: 27696 - RNA, 1410 nt, Artificial Sequence; identical to SEQ ID NO: 25324
  derived and/or modified CDS sequence (AUadapt) from InfluenzaA__AHZ36568__NA

SEQ ID NO: 27697 - RNA, 1410 nt, Artificial Sequence; identical to SEQ ID NO: 25324
  derived and/or modified CDS sequence (AUadapt) from InfluenzaA__AHZ36580__NA

SEQ ID NO: 27698 - RNA, 1410 nt, Artificial Sequence; identical to SEQ ID NO: 25324
  derived and/or modified CDS sequence (AUadapt) from InfluenzaA__AHZ36592__NA

SEQ ID NO: 27699 - RNA, 1410 nt, Artificial Sequence; identical to SEQ ID NO: 25324
  derived and/or modified CDS sequence (AUadapt) from InfluenzaA__AHZ36604__NA

SEQ ID NO: 27700 - RNA, 1410 nt, Artificial Sequence; identical to SEQ ID NO: 25324
  derived and/or modified CDS sequence (AUadapt) from InfluenzaA__AHZ36616__NA

SEQ ID NO: 27701 - RNA, 1410 nt, Artificial Sequence
  derived and/or modified CDS sequence (AUadapt) from InfluenzaA__AHZ36628__NA
augaaccccaaccagaagaucaucaccaucggcucggugucccugaccaucucgacgaucugcuucuucaugcagaucgccauccucaucaccaccgucacccugcacuucaagcagugcgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcgggcacggggucaagggcugggccuucgacgacgggaacgacguguggaugggccgcaccaucaacgagacgucgcggcucggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcccaucuga

SEQ ID NO: 27702 - RNA, 1410 nt, Artificial Sequence
  derived and/or modified CDS sequence (AUadapt) from InfluenzaA__AHZ36640__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccacgaccgcacccccuaccggacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcgccucguggacuccguggucagcugguccaaggagauccugcggacccaggagucggagugcgugugcaucaacggcacgugcaccguggucaugaccgacggguccgccagcggcaaggccgacaccaagauccuguucaucgaggagggcaagaucgugcacacgucgacccucuccgggucggcgcagcacguggaggagugcuccugcuacccccgcuacccgggcguccggugcgugugccgcgacaacuggaaggggagcaaccggcccaucguggacaucaacaucaaggaccacuccaucgucucguccuacgugugcagcggccuggugggcgacaccccgcgcaagaacgacuccucguccagcucccacugccuggaccccaacaacgaggagggcgggcacggggucaagggcugggccuucgacgacgggaacgacguguggaugggccggaccaucaacgagacgucgcgccucggcuacgagaccuucaaggucaucgaggggugguccaaccccaagagcaagcugcagaucaaccgccaggugaucguggaccggggcgaccgguccggguacucgggcaucuucuccgucgagggcaagagcugcaucaaccgcugcuucuacguggagcugauccgggggcgcaaggaggagaccgaggugcucuggaccucgaacuccaucgucguguucugcggcacgagcgggaccuacggcaccggguccuggcccgacggcgccgaccugaaccugaugcccaucuga

SEQ ID NO: 27703 - RNA, 1410 nt, Artificial Sequence; identical to SEQ ID NO: 25324
  derived and/or modified CDS sequence (AUadapt) from InfluenzaA__AHZ36652__NA

SEQ ID NO: 27704 - RNA, 1410 nt, Artificial Sequence; identical to SEQ ID NO: 16339
  derived and/or modified CDS sequence (AUadapt) from InfluenzaA__AHZ36664__NA

SEQ ID NO: 27705 - RNA, 1410 nt, Artificial Sequence; identical to SEQ ID NO: 16339
  derived and/or modified CDS sequence (AUadapt) from InfluenzaA__AHZ36676__NA

SEQ ID NO: 27706 - RNA, 1410 nt, Artificial Sequence; identical to SEQ ID NO: 16339
  derived and/or modified CDS sequence (AUadapt) from InfluenzaA__AHZ36688__NA

SEQ ID NO: 27707 - RNA, 1398 nt, Artificial Sequence; identical to SEQ ID NO: 16294
  derived and/or modified CDS sequence (AUadapt) from InfluenzaA__AHZ39689__NA

SEQ ID NO: 27708 - RNA, 1398 nt, Artificial Sequence; identical to SEQ ID NO: 16294
  derived and/or modified CDS sequence (AUadapt) from InfluenzaA__AHZ39713__NA

SEQ ID NO: 27709 - RNA, 1398 nt, Artificial Sequence; identical to SEQ ID NO: 16294
  derived and/or modified CDS sequence (AUadapt) from InfluenzaA__AHZ39725__NA

SEQ ID NO: 27710 - RNA, 1398 nt, Artificial Sequence; identical to SEQ ID NO: 16294
  derived and/or modified CDS sequence (AUadapt) from InfluenzaA__AHZ39737__NA

SEQ ID NO: 27711 - RNA, 1398 nt, Artificial Sequence
  derived and/or modified CDS sequence (AUadapt) from InfluenzaA__AHZ39749__NA
augaaucccaaccagaagauccugugcaucucggccaccgccaucaucaucggcgcgaucgccgugcucaucgggaucgccaaccugggccugaacaucgggcuccaccugaagccgggcugcaacugcucccacucgcagcccgagaccacgaacaccucccagaccaucaucaacaacuacuacaaugagaccaacaucacgaacauccagauggaggagcgcaccucgcggaacuucaacaaccugaccaaggggcucugcaccaucaacuccuggcacaucuacggcaaggacaacgccguccgcaucggcgagucguccgacgugcuggugacgcgggagcccuacgucucgugugaccccgacgagugccgcuucuacgcccugucccaggggaccaccauccggggcaagcacucgaacgggaccauccacgaccgcucccaguaccgggcgcucaucucguggccgcuguccucgccgcccacgguguacaacucccgcguggagugcaucggcuggucguccaccaguugccacgacgggaagucccggaugucgaucugcaucucgggccccaacaacaacgccuccgccgucgugugguacaaccgccggcccguggccgagaucaacaccugggcgcgcaacauccugcggacccaggagucggagugcgucugccacaauggcgugugccccguggucuucacggacggguccgccaccggccccgccgacacccgcaucuacuacuucaaggaggggaagauccucaagugggagucgcugaccggcacggccaagcacaucgaggagugcuccugcuacggcgagcggaccgggaucacgugcacgugccgcgacaacuggcagggcucgaaucggcccgugauccagaucgacccgguggccaugacccacaccucccaguacaucugcucgcccguccugaccgacaacccccgccccaacgacccgaacaucgggaagugcaacgaccccuaccccggcaacaacaacaauggggugaagggcuucuccuaccucgacggcgcgaacaccuggcuggggcggaccaucucgaccgccucccgcucgggcuacgagaugcugaaggugcccaacgcccucaccgacgaccgguccaagccgauccaggggcagaccaucguccugaacgccgacuggucgggcuacuccgggucguucauggacuauugggccgagggcgacugcuaccgcgcgugcuucuacguggagcugauccgcggccggcccaaggaggacaaggugugguggacguccaacucgaucgucuccaugugcucgucgaccgaguuccucgggcaguggaacuggcccgacggcgccaagaucgaguacuuccuguga

SEQ ID NO: 27712 - RNA, 1398 nt, Artificial Sequence; identical to SEQ ID NO: 27711
  derived and/or modified CDS sequence (AUadapt) from InfluenzaA__AHZ39761__NA

SEQ ID NO: 27713 - RNA, 1398 nt, Artificial Sequence; identical to SEQ ID NO: 16294
  derived and/or modified CDS sequence (AUadapt) from InfluenzaA__AHZ39773__NA

SEQ ID NO: 27714 - RNA, 1398 nt, Artificial Sequence; identical to SEQ ID NO: 16294
  derived and/or modified CDS sequence (AUadapt) from InfluenzaA__AHZ39785__NA

SEQ ID NO: 27715 - RNA, 1410 nt, Artificial Sequence
  derived and/or modified CDS sequence (AUadapt) from InfluenzaA__AHZ39797__NA
augaaccccaaccagaagaucaucaccaucggcucggugucccugaccaucucgacggucugcuucuucaugcagaucgccauccucaucaccaccgugacccugcacuucaagcaguacgaguucaacccgccgcccaacaaccaggugaugcugugcgagcccacgaucaucgagcgcaacaucaccgagaucgucuaccucaccaacaccacgaucgagaaggagaucugccccaagcccgccgaguaccggaacugguccaagccccagugcgggaucaccggcuucgcgcccuucagcaaggacaacuccauccgccugucggccgggggcgacaucugggugacccgggagccguacguguccugcgaccccgacaagugcuaccaguucgcccuggggcagggcaccacgcucaacaacguccacagcaacaacaccgugcgcgaccggacccccuaccgcacccugcugaugaacgagcucggcgugcccuuccaccuggggacgaagcaggucugcaucgccugguccucguccagcugccacgacggcaaggccuggcugcacgugugcaucaccggggacgacaagaacgcgaccgccuccuucaucuacaacggccggcucguggacucggucguguccuggagcaaggagauccugcgcacccaggaguccgagugcgugugcaucaacgggacgugcaccgucgugaugaccgacggcucggccuccggcaagagcgacaccaagauccuguucaucgaggaggggaagaucgugcacacgucgacccucuccggcucggcccagcacgucgaggagugcuccugcuacccgcgguaccccggggugcgcugcgugugccgggacaacuggaagggcagcaaccgccccaucgucgacaucaacaucaaggaccacuccaucgugucguccuacgugugcagcggccuggucggggacacgccccggaagaacgacuccucguccagcucccacugccuggacccgaacaacgaggagggcgggcacggcgugaaggggugggcguucgacgacggcaacgacgucuggaugggccgcaccaucaacgagaccucgcggcucggguacgagaccuucaaggugaucgagggcugguccaaccccaagagcaagcugcagaucaaccgccaggugaucgucgaccgcggggaccgguccggcuacucggggaucuucuccguggagggcaagagcugcaucaaccggugcuucuacguggagcugauccgcggccggaaggaggagaccgagguccucuggaccucgaacuccaucgugguguucugcgggacgagcggcaccuacgggaccggcuccuggcccgacggggccgaccugaaccugaugcccaucuga

SEQ ID NO: 27716 - RNA, 1410 nt, Artificial Sequence
  derived and/or modified CDS sequence (AUadapt) from InfluenzaA__AHZ39821__NA
augaaccccaaccagaagaucaucaccaucggcucggugucccugaccaucucgacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggucguccucguccugccacgacgggaaggccuggcuccacgugugcaucaccggcgacgacaagaacgcgaccgccagcuucaucuacaacgggcggcugguggacuccguggucucgugguccaaggagauccugcgcacgcaggagagcgagugcgugugcaucaacgggaccugcaccguggucaugaccgacggguccgccucgggcaaggccgacacgaagauccucuucaucgaggagggcaagaucgugcacaccagcacccuguccgggucggcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggcgcaacgacuccagcuccucgucccacugccucgaccccaacaacgaggagggcggccacggggucaagggcugggccuucgacgacgggaacgacguguggaugggccggaccaucaacgagaccucgcgccugggcuacgagaccuucaaggucaucgaggggugguccaaccccaagagcaagcugcagaucaaccgccaggugaucguggaccggggcaaccgguccggguacucgggcaucuucuccgucgagggcaagagcugcaucaaccgcugcuucuacguggagcucauccgggggcgcaaggaggagaccgaggugcuguggacgucgaacuccaucgucguguucugcggcaccagcgggaccuacggcaccggguccuggccggacggcgccgaccugaaccucaugcccacguga

SEQ ID NO: 27717 - RNA, 1410 nt, Artificial Sequence; identical to SEQ ID NO: 25791
  derived and/or modified CDS sequence (AUadapt) from InfluenzaA__AHZ39833__NA

SEQ ID NO: 27718 - RNA, 1410 nt, Artificial Sequence; identical to SEQ ID NO: 16339
  derived and/or modified CDS sequence (AUadapt) from InfluenzaA__AHZ39844__NA

SEQ ID NO: 27719 - RNA, 1410 nt, Artificial Sequence
  derived and/or modified CDS sequence (AUadapt) from InfluenzaA__AHZ39856__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccucguccugccacgacgggaaggccuggcugcacgugugcaucaccggcgacgacaagaacgcgaccgccagcuucaucuacaacgggcggcucguggacuccguggucucgugguccaaggagauccugcgcacccaggagagcgagugcgugugcaucaacggcacgugcaccguggucaugaccgacggguccgccucgggcaaggccgacaccaagauccuguucaucgaggagggcaagaucgugcacacgagcacccucuccgggucggcgcagcacguggaggagugcuccugcuacccccgguacccgggcguccgcugcgugugccgggacaacuggaaggggucgaaccgccccaucguggacaucaacaucaaggaccacuccaucgucagccgguacgugugcuccggccuggugggcgacacgccccgcaagaacgacucguccagcuccucgcacugccuggaccccaacaacgaggagggcgggcacggggucaagggcugggccuucgacgacgggaacgacguguggaugggccggaccaucaacgagaccucccgccucggcuacgagaccuucaaggucaucgagggguggucgaacccgaaguccaagcugcccaucaaccgccaggugaucguggaccggggcgaccggagcggguacuccggcaucuucucggucgaggggaaguccugcaucaaccgcugcuucuacguggagcugauccggggccgcaaggaggagaccgaggugcucuggaccagcaacucgaucgucguguucugcggcacguccgggaccuacggcaccgggagcuggcccgacggcgccgaccugaaccugaugcccaucuga

SEQ ID NO: 27720 - RNA, 1410 nt, Artificial Sequence; identical to SEQ ID NO: 16339
  derived and/or modified CDS sequence (AUadapt) from InfluenzaA__AHZ39868__NA

SEQ ID NO: 27721 - RNA, 1410 nt, Artificial Sequence
  derived and/or modified CDS sequence (AUadapt) from InfluenzaA__AHZ39892__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccagguggugcugugcgagcccacgaucaucgagcgcaacaucaccgagaucgucuaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggugacccgggagcccuacgugagcugcgacccggacaagugcuaccaguucgcccugggccaggggaccacgcucaacaacguccacuccaacaacaccgugcgcgaccggacccccuaccgcacccugcugaugaacgagcucggcgugcccuuccaccugggcacgaagcaggucugcaucgccuggucguccucguccugccacgacgggaaggccuggcugcacgugugcaucaccggcgacgacaagaacgcgaccgccagcuucaucuacaacgggcggcucguggacuccgucgugucgugguccaaggagauccugcgcacccaggagagcgagugcgugugcaucaacggcacgugcaccgucgugaugaccgacggguccgccucgggcaaggccgacaccaagauccuguucaucgaggagggcaagaucgugcacacgagcacccucuccgggucggcgcagcacgucgaggagugcuccugcuacccccgguacccgggcgugcgcugcgugugccgggacaacuggaaggggucgaaccgccccaucgucgacaucaacaucaaggaccacuccaucgugagccgguacgugugcuccggccuggucggcgacacgccccgcaagaacgacucguccagcuccucgcacugccuggaccccaacaacgaggagggcgggcacggggugaagggcugggccuucgacgacgggaacgacgucuggaugggccggaccaucaacgagaccucccgccucggcuacgagaccuucaaggugaucgagggguggucgaacccgaaguccaagcugcagaucaaccgccaggugaucgucgaccggggcgaccggagcggguacuccggcaucuucucgguggaggggaaguccugcaucaaccgcugcuucuacguggagcugauccggggccgcaaggaggagaccgagguccucuggaccagcaacucgaucgugguguucugcggcacguccgggaccuacggcaccgggagcuggcccgacggcgccgaccugaaccugaugcccaucuga

SEQ ID NO: 27722 - RNA, 1410 nt, Artificial Sequence; identical to SEQ ID NO: 25756
  derived and/or modified CDS sequence (AUadapt) from InfluenzaA__AHZ39904__NA

SEQ ID NO: 27723 - RNA, 1410 nt, Artificial Sequence; identical to SEQ ID NO: 25756
  derived and/or modified CDS sequence (AUadapt) from InfluenzaA__AHZ39916__NA

SEQ ID NO: 27724 - RNA, 1410 nt, Artificial Sequence; identical to SEQ ID NO: 16339
  derived and/or modified CDS sequence (AUadapt) from InfluenzaA__AHZ39928__NA

SEQ ID NO: 27725 - RNA, 1410 nt, Artificial Sequence
  derived and/or modified CDS sequence (AUadapt) from InfluenzaA__AHZ39940__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaugaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaccgacuccucguccagcucccacugccuggaccccaacaacgaggagggcgggcacggcgucaaggggugggccuucgacgacggcaacgacguguggaugggccgcacgaucaacgagaccucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggacgucgaacuccaucgucguguucugcgggaccagcggcaccuacgggaccggcuccuggcccgacggggccgaccugaaccugaugcccaucuga

SEQ ID NO: 27726 - RNA, 1410 nt, Artificial Sequence; identical to SEQ ID NO: 16339
  derived and/or modified CDS sequence (AUadapt) from InfluenzaA__AHZ39952__NA

SEQ ID NO: 27727 - RNA, 1410 nt, Artificial Sequence; identical to SEQ ID NO: 16339
  derived and/or modified CDS sequence (AUadapt) from InfluenzaA__AHZ39976__NA

SEQ ID NO: 27728 - RNA, 1410 nt, Artificial Sequence
  derived and/or modified CDS sequence (AUadapt) from InfluenzaA__AHZ39988__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacaugcacuccaacaacaccgugcgcgaccggacccccuaccgcacccugcugaugaacgagcucggcguccccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggugagcugguccaaggagauccugcgcacccaggagucggagugcgucugcaucaacgggacgugcaccguggugaugaccgacggcuccgccagcggcaaggccgacaccaagauccuguucaucgaggaggggaagaucguccacacgucgacccucuccggcucgacccagcacguggaggagugcuccugcuacccccgguacccgggggugcgcugcgucugccgggacaacuggaagggcagcaaccgccccaucguggacaucaacaucaaggaccacuccaucgugucguccuacgucugcagcggccuggugggggacaccccgcggaagaacgacuccucguccagcucccacugccuggaccccaacaacgaggagggcgggcacggcgugaaggggugggcguucgacgacggcaacgacgucuggaugggccgcacgaucaacgagaccucgcggcucggguacgagaccuucaaggugaucgagggcugguccaaccccaagagcaagcugcagaucaaccgccaggucaucguggaccgcggggaccgguccggcuacucggggaucuucuccguggagggcaagagcugcaucaaccggugcuucuacgucgagcugauccgcggccggaaggaggagaccgaggugcucuggacgucgaacuccaucguggucuucugcgggaccagcggcaccuacgggaccggcuccuggcccgacggggccgaccugaaccugaugcccaucuga

SEQ ID NO: 27729 - RNA, 1410 nt, Artificial Sequence; identical to SEQ ID NO: 16339
  derived and/or modified CDS sequence (AUadapt) from InfluenzaA__AHZ40000__NA

SEQ ID NO: 27730 - RNA, 1410 nt, Artificial Sequence; identical to SEQ ID NO: 16339
  derived and/or modified CDS sequence (AUadapt) from InfluenzaA__AHZ40012__NA

SEQ ID NO: 27731 - RNA, 1410 nt, Artificial Sequence
  derived and/or modified CDS sequence (AUadapt) from InfluenzaA__AHZ40024__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggucgaagccccagugcgggaucaccggcuucgcgcccuucuccaaggacaacagcauccgccuguccgccgggggcgacaucugggucacccgggagcccuacgugucgugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccucguccugccacgacggcaaggccuggcugcacgugugcaucaccggggacgacaagaacgcgaccgccagcuucaucuacaacggccggcucguggacuccguggucucgugguccaaggagauccugcgcacccaggagagcgagugcgugugcaucaacgggacgugcaccguggucaugaccgacggcuccgccucgggcaaggccgacaccaagauccuguucaucgaggaggggaagaucgugcacacgagcacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguucgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27732 - RNA, 1410 nt, Artificial Sequence; identical to SEQ ID NO: 16339
  derived and/or modified CDS sequence (AUadapt) from InfluenzaA__AHZ40036__NA

SEQ ID NO: 27733 - RNA, 1410 nt, Artificial Sequence; identical to SEQ ID NO: 25759
  derived and/or modified CDS sequence (AUadapt) from InfluenzaA__AHZ40048__NA

SEQ ID NO: 27734 - RNA, 1410 nt, Artificial Sequence; identical to SEQ ID NO: 16339
  derived and/or modified CDS sequence (AUadapt) from InfluenzaA__AHZ40063__NA

SEQ ID NO: 27735 - RNA, 1410 nt, Artificial Sequence
  derived and/or modified CDS sequence (AUadapt) from InfluenzaA__AHZ40075__NA
augaaccccaaccagaagaucaucaccaucggcucggugucccugaccaucucgacggucugcuucuucaugcagaucgccauccucaucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccgucgugagcugguccaaggagauccugcgcacccaggagucggagugcgugugcaucaacgggacgugcaccgucgugaugaccgacggcuccgccagcggcaaggccgacaccaagauccuguucaucgaggaggggaagaucgugcacacgucgacccucuccggcagcgcgcagcacgucgaggagugcuccugcuacccccgguacccgggggugcgcugcgugugccgggacaacuggaagggcucgaaccgccccaucgucgacaucaacaucaaggaccacuccaucgugagcuccuacgugugcucgggccuggucggggacacgccccggaagaacgacuccagcuccucgucccacugccuggaccccaacaacgaggagggcgggcacggcgugaaggggugggccuucgacgacggcaacgacgucuggaugggccgcaccaucaacgagaccagccggcucggguacgagaccuucaaggugaucgagggcugguccaacucgaaguccaagcugcagaucaaccgccaggugaucgucgaccgcggggaccggagcggcuacuccgggaucuucucgguggagggcaagagcugcaucaaccggugcuucuacguggagcugauccgcggccggaaggaggagaccgagguccucuggaccuccaacucgaucgugguguucugcgggacguccggcaccuacgggaccggcagcuggccggacggggccgaccugaaccugaugcccaucuga

SEQ ID NO: 27736 - RNA, 1410 nt, Artificial Sequence; identical to SEQ ID NO: 16339
  derived and/or modified CDS sequence (AUadapt) from InfluenzaA__AHZ40087__NA

SEQ ID NO: 27737 - RNA, 1410 nt, Artificial Sequence; identical to SEQ ID NO: 25759
  derived and/or modified CDS sequence (AUadapt) from InfluenzaA__AHZ40099__NA

SEQ ID NO: 27738 - RNA, 1410 nt, Artificial Sequence
  derived and/or modified CDS sequence (AUadapt) from InfluenzaA__AHZ40111__NA
augaaccccaaccagaagaucaucaccaucggcucggugucccugaccaucucgacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugcccgaagcuggccgaguaccggaacugguccaagccccagugcgacaucaccggguucgcgcccuucagcaaggacaacuccauccgccugucggccggcggggacaucugggucacccgggagcccuacguguccugcgacccggacaagugcuaccaguucgcccucggccaggggaccacgcugaacaacgugcacucgaacaacaccguccgcgaccggacccccuaccgcacccugcucaugaacgagcugggcgugcccuuccaccugggcacgaagcaggucugcaucgccugguccagcuccucgugccacgacgggaaggccuggcuccacgugugcaucaccggcgacgacaagaacgcgaccgccuccuucaucuacaacgggcggcugguggacagcguggucuccuggucgaaggacauccugcgcacccaggaguccgagugcgugugcaucaacggcacgugcgccguggucaugaccgacgggucggccuccggcaaggcggacaccaagauccucuucaucgaggagggcaagaucgugcacaccagcacgcugucgggguccgcccagcacguggaggagugcagcugcuacccccgguacccgggcguccgcugcgugugccgggacaacuggaagggguccaaccgccccaucguggacaucaacaucaaggaccacucgaucgucuccucguacgugugcuccggccuggugggcgacacgccccggaagaacgacagcuccucguccgggcacugccucgaccccaacaacgaggagggcgggcacggcgucaaggggugggccuucgacgacggcaacgacguguggaugggccgcaccaucaacgagaccagccggcugggguacgagaccuucaaggucaucgagggcugguccaaccccaagucgaagcugcagaucaaccgccaggugaucguggaccgggggaaccgcuccggcuacucggggaucuucuccgucgagggcaagaacugcaucaaccggugcuucuacguggagcucauccgcggccggaaggaggagaccgaggugcuguggaccagcaacuccaucgucguguucugcgggaccucgggcacguacgggaccggcagcuggcccgacggggccgaccugaaccucaugcccaucuga

SEQ ID NO: 27739 - RNA, 1410 nt, Artificial Sequence
  derived and/or modified CDS sequence (AUadapt) from InfluenzaA__AHZ40123__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaccgagcgcaacaucaccgagaucguguaccucaccaacacgaccaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugucgugcgacccggacaagugcuaccaguucgcccuggggcagggcacgacccucaacaacgugcacuccaacaacaccguccgcgaccggacccccuaccgcacgcugcugaugaacgagcucggcgugcccuuccaccuggggaccaagcaggucugcaucgccuggagcuccucguccugccacgacggcaaggccuggcugcacgugugcaucaccggggacgacaagaacgcgaccgccagcuucaucuacaacggccggcucguggacuccguggucucgugguccaaggagauccugcgcacgcaggagucggagugcgugugcaucaacgggaccugcaccguggucaugaccgacggcuccgccagcggcaaggccgacacgaagauccuguucaucgaggaggggaagaucgugcacacccggacccucucgggcuccgcgcagcacguggaggagugcucgugcuacccccgcuacccggggguccggugcgugugccgcgacaacuggaagggcuccaaccggcccaucguggacaucaacaucaaggaccacagcaucgucuccucguacgugugcuccggccuggugggggacacgccccgcaagaacgacagcuccucguccucgcacugccuggaccccaacaacgaggagggcgggcacggcgucaaggggugggccuucgacgacggcaacgacguguggaugggccggaccaucaacgagaccucccgccucggguacgagaccuucaaggucaucgagggcuggagcaacccgaaguccaagcugcagaucaaccggcaggucaucguggaccgcggggaccggucgggcuacuccgggaucuucucgguggagggcaaguccugcaucaaccgcugcuucuacguggagcugauccggggccgcaaggaggagaccgaggugcucuggacgagcaacucgaucgucguguucugcgggaccuccggcaccuacgggaccggcagcuggcccgacggggccgaccugaaccugaugcccaucuga

SEQ ID NO: 27740 - RNA, 1410 nt, Artificial Sequence; identical to SEQ ID NO: 16339
  derived and/or modified CDS sequence (AUadapt) from InfluenzaA__AHZ40133__NA

SEQ ID NO: 27741 - RNA, 1410 nt, Artificial Sequence; identical to SEQ ID NO: 25766
  derived and/or modified CDS sequence (AUadapt) from InfluenzaA__AHZ40145__NA

SEQ ID NO: 27742 - RNA, 1410 nt, Artificial Sequence
  derived and/or modified CDS sequence (AUadapt) from InfluenzaA__AHZ40157__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagcugugccccaagcuggccgaguaccggaacuggucgaagccgcagugcgacaucaccggguucgcgcccuucuccaaggacaacagcauccgccucuccgccggcggggacaucugggucacccgggagcccuacgugucgugcgaccccgacaagugcuaccaguucgcccugggccaggggaccacgcugaacaacgugcacuccaacaacaccguccgcgaccggaccccguaccgcacccuccugaugaacgagcugggcgugcccuuccaccucggcacgaagcaggucugcauggccuggagcuccucguccugccacgacgggaaggccuggcugcacgugugcaucaccggcgacgacaagaacgcgaccgccagcuucaucuacaacgggaagcugguggacuccguggucucgugguccaaggagauccuccggacccaggagagcgagugcgugugcaucaacggcacgugcaccguggucaugaccgacggguccgccucgggcaaggccgacaccaagauccuguucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccucgugggcgacacgccccgcaagaccgacuccucguccagcucccacugccuggaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcuccagaucaaccgccaggugaucguggaccggggcgaccgguccggguacucgggcaucuucuccgucgagggcaagagcugcaucaaccgcugcuucuacguggagcugauccgggggcgcaaggaggagaccgccgugcuguggacgucgaacuccaucgucguguucugcggcaccagcgggaccuacggcaccggguccuggccggacggcgccgaccucaaccugaugcccaucuga

SEQ ID NO: 27743 - RNA, 1410 nt, Artificial Sequence
  derived and/or modified CDS sequence (AUadapt) from InfluenzaA__AHZ40169__NA
augaaccccaaccagaagaucaucaccaucggcucggugugcaugaccaucgggauggccaaccugauccuccagaucggcaacaucaucuccaucuggaucagccacuccauccagcuggagaaccagagccagaucgagacgugcaaccaguccgucaucaccuacgagaacaacaccugggugaaccagaccuacgugaacaucagcaacacgaacuucgccgcggggcaguccgucgugagcgugaagcuggccggcaacuccucgcucugcccggucuccgggugggccaucuacagcaaggacaacuccgugcgcaucggcagcaagggcgacguguucgucauccgggagcccuucaucuccugcagcccccuggagugccgcaccuucuuccugacccagggggcccuccugaacgacaagcacuccaacggcaccaucaaggaccggagccccuaccgcacgcugauguccugcccgaucggggaggugcccagccccuacaacucgcgguucgaguccguggccuggagcgcguccgccugccacgacggcaucaacuggcucaccaucgggaucagcggccccgacuccggcgccgucgccgugcugaaguacaacgggaucaucaccgacaccaucaagagcuggcgcaacaacauccugcggacgcaggaguccgagugcgcgugcgugaacggcagcugcuucaccaucaugaccgacgggccguccgacggccaggccagcuacaagaucuuccgcaucgagaagggcaagaucgucaaguccguggagaugaacgcccccaacuaccacuacgaggagugcucgugcuaccccgacuccagcgagaucacgugcgugugccgggacaacuggcacggguccaaccgccccugggucagcuucaaccagaaccucgaguaccagaucggcuacaucugcuccgggaucuucggcgacaacccgcggcccaacgacaagaccgggagcugcggccccguguccagcaacggcgccaacggggugaagggcuucagcuucaaguacgggaacggcgucuggaucgggcgcaccaaguccaucucgucccggaagggcuucgagaugaucugggaccccaacggcuggaccgggaccgacaacaacuucagcaucaagcaggacaucgugggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 27744 - RNA, 1410 nt, Artificial Sequence
  derived and/or modified CDS sequence (AUadapt) from InfluenzaA__AHZ40180__NA
augaaccccaaccagaagaucaucaccaucggcucggugucccugaccaucucgacgaucugcuucuucaugcagaucaccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagccggccgaguaccggaacuggagcaagccccagugcgggaucaccggcuucgcccccuucuccaaggacaacucgauccgccuguccgccgggggcgacaucugggucacccgggagcccuacgugagcugcgacccggacaagugcuaccaguucgcgcuggggcagggcacgacccucaacaacgugcacuccaacaacaccguccgcgaccggacccccuaccgcacgcugcugaugaacgagcucggcgugcccuuccaccuggggaccaagcaggucugcaucgccuggucguccagcuccugccacgacggcaaggccuggcugcacgugugcaucaccggggacgacaagaacgccaccgcgucguucaucuacaacggccggcucguggacuccguggucagcugguccaaggagauccugcgcacgcaggagucggagugcgugugcaucaacgggaccugcaccguggucaugaccgacggcuccgccagcggcaaggccgacacgaagauccuguucaucgaggaggggaagaucgugcacaccucgacccucuccggcucggcccagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggcguucgacgacggcaacgacguguggaugggccgcacgaucaacgagaccucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggacgucgaacuccaucgucguguucugcgggaccagcggcaccuacgggaccggcuccuggcccgacggggccgaccugaaccugaugcccaucuga

SEQ ID NO: 27745 - RNA, 1410 nt, Artificial Sequence; identical to SEQ ID NO: 25412
  derived and/or modified CDS sequence (AUadapt) from InfluenzaA__AHZ40192__NA

SEQ ID NO: 27746 - RNA, 1410 nt, Artificial Sequence; identical to SEQ ID NO: 16339
  derived and/or modified CDS sequence (AUadapt) from InfluenzaA__AHZ40204__NA

SEQ ID NO: 27747 - RNA, 1410 nt, Artificial Sequence; identical to SEQ ID NO: 16339
  derived and/or modified CDS sequence (AUadapt) from InfluenzaA__AHZ40216__NA

SEQ ID NO: 27748 - RNA, 1410 nt, Artificial Sequence; identical to SEQ ID NO: 25777
  derived and/or modified CDS sequence (AUadapt) from InfluenzaA__AHZ40228__NA

SEQ ID NO: 27749 - RNA, 1410 nt, Artificial Sequence
  derived and/or modified CDS sequence (AUadapt) from InfluenzaA__AHZ40240__NA
augaaccccaaccagaagaucaucaccaucggcucggugucccugaccaucucgacgaucugcuuccucaugcagaucgccauccugaucaccaccgccacccugcacuucaagcaguacgaguucaacuccccgcccaacaaccaggucaugcucugcgagcccacgaucaucgagcgcaacaucaccgagaucguguaccugaccaacaccacgaucgagaaggagaucugccccaagccggcggaguaccggaacuggagcaagccccagugcgggaucaccggcuucgcccccuucuccaaggacaacucgauccgccuguccgccgggggcgacaucugggugacccgggagcccuacgucucgugcgacccggacaagugcuaccaguucgcccucgggcagggcaccacgcugaacaacgugcacuccaacaacaccgugcgcgaccggacccccuaccgcacccugcucaugaacgagcugggcguccccuuccaccuggggacgaagcaggucugcaucgccuggagcuccucguccugccacgacggcaaggcguggcuccacgugugcaucaccggggacgacaagaacgccaccgccagcuucaucuacaacggccggcugguggacuccguggugucgugguccaaggagauccugcgcacccaggagucggagugcgucugcaucaacgggacgugcaccguggugaugaccgacggcuccgccagcggcaaggcggacaccaagauccucuucaucgaggaggggaagaucguccacacgucgacccuguccggcucggcccagcacguggaggagugcuccugcuacccccgguacccgggggugcgcugcgucugccgggacaacuggaagggcagcaaccgccccaucguggacaucaacaucaaggaccgguccaucgugucguccuacgucugcagcggccuggugggggacaccccgcgcaagaacgacuccucguccucgucccacugccucgaccccaacaacgaggagggcgggcacggcgugaaggggugggccuucgacgacggcaacgacgucuggaugggccggaccaucaacgagacgagccgccugggguacgagaccuucaaggugaucgagggcugguccaaccccaagucgaagcugcagaucaaccggcaggucaucguggaccgcggggaccgguccggcuacucggggaucuucuccguggagggcaagagcugcaucaaccgcugcuucuacgucgagcucauccggggccgcaaggaggagaccgaggugcuguggaccucgaacuccaucguggucuucugcgggacgagcggcaccuacgggaccggcuccuggcccgacggggccgaccugaaccucaugcccaucuga

SEQ ID NO: 27750 - RNA, 1410 nt, Artificial Sequence
  derived and/or modified CDS sequence (AUadapt) from InfluenzaA__AHZ40252__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggaggacaagaacgcgaccgccucguucaucuacaacggccggcucguggacuccaucgugagcugguccaaggagauccugcgcacccaggagucggagugcgucugcaucaacgggacgugcaccguggugaugaccgacggcuccgccagcggcaaggccgacaccaagauccuguucaucgaggaggggaagaucguccacacgucgacccucuccggcucggcgcagcacguggaggagugcuccugcuacccccgguacccgggggugcgcugcgucugccgggacaacuggaagggcagcaaccgccccaucguggacaucaacaucaaggaccacuccaucgugucguccuacgucugcagcggccuggugggggacaccccgcggaagaacgacuccucguccagcucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggucaucguggaccgcggggaccgguccggcuacucggggaucuucuccguggagggcaagagcugcaucaaccggugcuucuacgucgagcugauccgcggccggaaggaggagaccgaggugcucuggaccucgaacuccaucguggucuucugcgggacgagcggcaccuacgggaccggcuccuggcccgacggggccgaccugaaccugaugcccaucuga

SEQ ID NO: 27751 - RNA, 1410 nt, Artificial Sequence; identical to SEQ ID NO: 27496
  derived and/or modified CDS sequence (AUadapt) from InfluenzaA__AHZ40264__NA

SEQ ID NO: 27752 - RNA, 1410 nt, Artificial Sequence; identical to SEQ ID NO: 16339
  derived and/or modified CDS sequence (AUadapt) from InfluenzaA__AHZ40276__NA

SEQ ID NO: 27753 - RNA, 1410 nt, Artificial Sequence
  derived and/or modified CDS sequence (AUadapt) from InfluenzaA__AHZ40288__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccgugaucucgugguccaaggacauccugcgcacccaggagagcgagugcgucugcaucaacggcacgugcgccguggugaugaccgacggguccgccucgggcaaggcggacaccaagauccucuucaucgaggagggcaagaucguccacaccagcacgcuguccgggucggcccagcacguggaggagugcuccugcuacccccgguaccccggcgugcgcugcgucugccgggacaacuggaaggggagcaaccgcccgaucguggacaucaacaucaaggaccacuccaucgugucguccuacgucugcucgggccuggugggcgacacgccccggaagaacgacuccagcuccucggggcacugccucgaccccaacaacgaggagggcgggcacggcgugaaggggugggccuucgacgacggcaacgacgucuggaugggccgcaccaucaacgagaccucccggcugggguacgagaccuucaaggugaucgagggcuggagcaaccccaaguccaagcugcagaucaaccgccaggucaucguggaccgggggaaccgcucgggcuacuccgggaucuucagcguggagggcaagaacugcaucaaccggugcuucuacgucgagcucauccgcggccggaaggaggagaccgaggugcuguggaccuccaacucgaucguggucuucugcgggaccagcggcacguacgggaccggcuccuggccggacggggccgaccugaaccucaugcccaucuga

SEQ ID NO: 27754 - RNA, 1410 nt, Artificial Sequence
  derived and/or modified CDS sequence (AUadapt) from InfluenzaA__AHZ40312__NA
augaaccccaaccagaagaucaucaccaucggcucggugucccugaccaucucgacgaucugcuucuucaugcagaucgccauccucaucaccaccgucacccugcacuucaagcaguacgaguucaacuacccgcccaacaaccaggugaugcugugcgagcccacgaucaucgagcgcaacaucaccgagaucguguaccucaccaacaccacgaucgagaaggagaucugccccaagccggccgaguaccggaacugguccaagccccagugcgggaucaccggcuucgcgcccuucagcaaggacaacuccauccgccugucggccgggggcgacaucugggucacccgggagcccuacguguccugcgacccggacaagugcuaccaguucgcccuggggcagggcaccacgcucaacaacgugcacagcaacaacaccguccgcgaccggacccccuaccgcacccugcugaugaacgagcucggcgugcccuuccaccuggggacgaagcaggucugcaucgccugguccucguccagcugccacgacggcaaggccuggcugcacgugugcaucaccggggacgacaagaacgcgaccgccuccuucaucuacaacggccggcucguggacucgguggucuccuggagcaaggagauccugcgcacccaggaguccgagugcgugugcaucaacgggacgugcaccguggucaugaccgacggcucggccuccggcaaggccgacaccaagauccuguucaucgaggaggggaagaucgugcacacgagcacccucucgggcuccgcgcagcacguggaggagugcucgugcuacccccgguacccggggguccgcugcgugugccgggacaacuggaagggcuccaaccgccccaucguggacaucaacaucaaggaccacagcgucguguccucguacgugugcuccggccuggucggggacacgccccggaagaacgacagcuccucguccagccacugccuggaccccaacaacgaggagggcgggcacggcgugaaggggugggccuucgacgacggcaacgacgucuggaugggccgcaccaucaacgagaccucccggcucggguacgagaccuucaaggugaucgagggcuggucgaacccgaaguccaagcugcagaucaaccgccaggugaucgucgaccgcggggaccggagcggcuacuccgggaucuucucgguggagggcaaguccugcaucaaccggugcuucuacguggagcugauccgcggccggaaggaggagaccgagguccucuggaccagcaacucgaucgugguguucugcgggacguccggcaccuacgggaccggcagcuggcccgacggggccgaccugaaccugaugcccaucuga

SEQ ID NO: 27755 - RNA, 1410 nt, Artificial Sequence; identical to SEQ ID NO: 16339
  derived and/or modified CDS sequence (AUadapt) from InfluenzaA__AHZ40324__NA

SEQ ID NO: 27756 - RNA, 1410 nt, Artificial Sequence; identical to SEQ ID NO: 16339
  derived and/or modified CDS sequence (AUadapt) from InfluenzaA__AHZ40336__NA

SEQ ID NO: 27757 - RNA, 1410 nt, Artificial Sequence; identical to SEQ ID NO: 27731
  derived and/or modified CDS sequence (AUadapt) from InfluenzaA__AHZ40348__NA

SEQ ID NO: 27758 - RNA, 1410 nt, Artificial Sequence; identical to SEQ ID NO: 25756
  derived and/or modified CDS sequence (AUadapt) from InfluenzaA__AHZ40360__NA

SEQ ID NO: 27759 - RNA, 1410 nt, Artificial Sequence
  derived and/or modified CDS sequence (AUadapt) from InfluenzaA__AHZ40372__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgaccacggggucaagggcugggccuucgacgacgggaacgacguguggaugggccgcaccaucaacgagacgucgcggcucggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcccaucuga

SEQ ID NO: 27760 - RNA, 1410 nt, Artificial Sequence; identical to SEQ ID NO: 25412
  derived and/or modified CDS sequence (AUadapt) from InfluenzaA__AHZ40384__NA

SEQ ID NO: 27761 - RNA, 1410 nt, Artificial Sequence; identical to SEQ ID NO: 16339
  derived and/or modified CDS sequence (AUadapt) from InfluenzaA__AHZ40396__NA

SEQ ID NO: 27762 - RNA, 1410 nt, Artificial Sequence; identical to SEQ ID NO: 16339
  derived and/or modified CDS sequence (AUadapt) from InfluenzaA__AHZ40408__NA

SEQ ID NO: 27763 - RNA, 1410 nt, Artificial Sequence; identical to SEQ ID NO: 16339
  derived and/or modified CDS sequence (AUadapt) from InfluenzaA__AHZ40420__NA

SEQ ID NO: 27764 - RNA, 1410 nt, Artificial Sequence
  derived and/or modified CDS sequence (AUadapt) from InfluenzaA__AHZ40432__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccucguccugccacgacgggaaggccuggcugcacgugugcaucaccggcgacgacaagaacgcgaccgccagcuucaucuacaacgggcggcucguggacuccguggucucgugguccaaggagauccugcgcacccaggagagcgagugcgugugcaucaacggcacgugcaccguggucaugaccgacggguccgccucgggcaaggccgacaccaagauccuguucaucgaggagggcaagaucgugcacacgagcacccucuccgggucggcgcagcacguggaggagugcuccugcuacccccgguacccgggcguccgcugcgugugccgggacaacuggaaggggucgaaccgccccaucaucgacaucaacaucaaggaccacuccaucgugagccgguacgucugcuccggccuggugggcgacacgccccgcaagaacgacucguccagcuccucgcacugccuggaccccaacaacgaggagggcgggcacggggugaagggcugggccuucgacgacgggaacgacgucuggaugggccggaccaucaacgagaccucccgccucggcuacgagaccuucaaggugaucgagggguggucgaacccgaaguccaagcugcagaucaaccggcaggucaucguggaccgcggcgaccggagcggguacuccggcaucuucucgguggaggggaaguccugcaucaaccgcugcuucuacgucgagcugauccggggccgcaaggaggagaccgaggugcucuggaccagcaacucgaucguggucuucugcggcacguccgggaccuacggcaccgggagcuggcccgacggcgccgaccugaaccugaugcccaucuga

SEQ ID NO: 27765 - RNA, 1410 nt, Artificial Sequence; identical to SEQ ID NO: 16339
  derived and/or modified CDS sequence (AUadapt) from InfluenzaA__AHZ40444__NA

SEQ ID NO: 27766 - RNA, 1410 nt, Artificial Sequence
  derived and/or modified CDS sequence (AUadapt) from InfluenzaA__AHZ40456__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacaugcacuccaacaacaccgugcgcgaccggacccccuaccgcacccugcugaugaacgagcucggcguccccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggugagcugguccaaggagauccugcgcacccaggagucggagugcgucugcaucaacggcacgugcaccguggugaugaccgacggguccgccagcggcaaggccgacaccaagauccuguucaucgaggagggcaagaucguccacacgucgacccucuccgggucggcgcagcacguggaggagugcuccugcuacccccgguacccgggcgugcgcugcgucugccgggacaacuggaaggggagcaaccgccccaucguggacaucaacaucaaggaccacuccaucgugucguccuacgucugcagcggccuggugggcgacaccccgcggaagaacgacuccucguccagcucccacugccuggaccccaacaacgaggagggcgggcacggggugaagggcugggccuucgacgacgggaacgacgucuggaugggccgcaccaucaacgagacgucgcggcucggcuacgagaccuucaaggugaucgaggggugguccaaccccaagagcaagcugcagaucaaccgccaggucaucguggaccggggcgaccgcuccggguacucgggcaucuucuccguggagggcaagagcugcaucaaccggugcuucuacgucgagcugauccgcgggcggaaggaggagaccgaggugcucuggaccucgaacuccaucguggucuucugcggcacgagcgggaccuacggcaccggguccuggcccgacggcgccgaccugaaccugaugcccaucuga

SEQ ID NO: 27767 - RNA, 1410 nt, Artificial Sequence
  derived and/or modified CDS sequence (AUadapt) from InfluenzaA__AHZ40468__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccgggaacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27768 - RNA, 1410 nt, Artificial Sequence; identical to SEQ ID NO: 25756
  derived and/or modified CDS sequence (AUadapt) from InfluenzaA__AHZ40480__NA

SEQ ID NO: 27769 - RNA, 1410 nt, Artificial Sequence; identical to SEQ ID NO: 27194
  derived and/or modified CDS sequence (AUadapt) from InfluenzaA__AHZ40492__NA

SEQ ID NO: 27770 - RNA, 1410 nt, Artificial Sequence; identical to SEQ ID NO: 16339
  derived and/or modified CDS sequence (AUadapt) from InfluenzaA__AHZ40503__NA

SEQ ID NO: 27771 - RNA, 1410 nt, Artificial Sequence; identical to SEQ ID NO: 16339
  derived and/or modified CDS sequence (AUadapt) from InfluenzaA__AHZ40515__NA

SEQ ID NO: 27772 - RNA, 1410 nt, Artificial Sequence
  derived and/or modified CDS sequence (AUadapt) from InfluenzaA__AHZ40527__NA
augaaccccaaccagaagaucaucaccaucggcucggugucccugaccaucucgacgaugugcuucuucaugcagaucgccauccucaucaccaccgucacccugcacuucaagcaguacgaguucgacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27773 - RNA, 1410 nt, Artificial Sequence
  derived and/or modified CDS sequence (AUadapt) from InfluenzaA__AHZ40539__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugaacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27774 - RNA, 1410 nt, Artificial Sequence; identical to SEQ ID NO: 16339
  derived and/or modified CDS sequence (AUadapt) from InfluenzaA__AHZ40551__NA

SEQ ID NO: 27775 - RNA, 1410 nt, Artificial Sequence
  derived and/or modified CDS sequence (AUadapt) from InfluenzaA__AHZ40563__NA
augaaccccaaccagaagaucaucaccaucggcucggugucccugaccaucagcacggucugcuucuucaugcagaucgccauccucaucaccaccgugacccugcacuucaagcaguacgaguucaacuccucgccgaacaaccaggugaugcugugcgagcccacgaucaucgagcgcaacaucaccgagaucgucuaccucaccaacaccacgaucgagaaggagaucugccccaagcccgccgaguaccggaacugguccaagccgcagugcgggaucaccggcuucgcgcccuucagcaaggacaacuccauccgccugucggccgggggcgacaucugggugacccgggagcccuacguguccugcgaccccgacaagugcuaccaguucgcccuggggcagggcaccacgcucaacaacguccacagcaacaacaccgugcgcgaccggaccccguaccgcacccugcugaugaacgagcucggcgugcccuuccaccuggggacgaagcaggucugcaucgccugguccucguccagcugccacgacggcaaggccuggcugcacgugugcaucaccggggacgacaagaacgcgaccgccuccuucaucuacaacggccggcucguggacucggucguguccuggagcaaggagauccugcgcacccaggaguccgagugcgugugcaucaacgggacgugcaccgucgugaugaccgacggcucggccagcggcaaggccgacaccaagauccuguucaucgaggaggggaagaucgugcacacguccacccucucgggcuccgcgcagcacgucgaggagugcagcugcuacccccgguaccccggggugcgcugcgugugccgggacaacuggaagggcuccaaccgcccgaucgucgacaucaacaucaaggaccacucgaucguguccagcuacgugugcuccggccuggucggggacacgccccggaagaacgacucguccagcuccucgcacugccuggaccccaacaacgaggagggcgggcacggcgugaaggggugggccuucgacgacggcaacgacgucuggaugggccgcaccaucaacgagaccucccggcucggguacgagaccuucaaggugaucgagggcuggagcaacuccaagucgaagcugcagaucaaccgccaggugaucgucgaccgcggggaccgguccggcuacagcgggaucuucucgguggagggcaaguccugcaucaaccggugcuucuacguggagcugauccgcggccggaaggaggagaccgagguccucuggaccagcaacuccaucgugguguucugcgggacgagcggcaccuacgggaccggcuccuggcccgacggggccgaccugaaccugaugccgaucuga

SEQ ID NO: 27776 - RNA, 1410 nt, Artificial Sequence
  derived and/or modified CDS sequence (AUadapt) from InfluenzaA__AHZ40575__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcagcgcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacaccccgcggaagaacgacuccagcuccucgucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagucgaagcugcagaucucccgccaggugaucguggaccgcggggaccggagcggcuacuccgggaucuucucggucgagggcaagagcugcaucaaccggugcuucuacguggagcugauccgcggccggaaggaggagaccgaggugcucuggaccuccaacucgaucgucguguucugcgggacguccggcaccuacgggaccggcagcuggcccgacggggccgaccugaaccugaugcccaucuga

SEQ ID NO: 27777 - RNA, 1410 nt, Artificial Sequence; identical to SEQ ID NO: 27495
  derived and/or modified CDS sequence (AUadapt) from InfluenzaA__AHZ40586__NA

SEQ ID NO: 27778 - RNA, 1410 nt, Artificial Sequence
  derived and/or modified CDS sequence (AUadapt) from InfluenzaA__AHZ40598__NA
augaaccccaaccagaagaucaucaccaucggcucggugugcaugaccaucgggauggccaaccugauccuccagaucggcaacaucaucuccaucuggaucagccacuccauccaggucgggaaccagagccagaucgagacgugcaaccaguccgugaucaccuacgagaacaacaccugggugaaccagaccuacgucaacaucagcaacacgaacuucgccgcgggccagccggugguguccgucaagcuggccgggaacucgucccugugccccgugagcggcugggccaucuacuccaaggacaacagcgugcgcaucggcuccaagggggacgucuucgugauccgggagcccuucaucagcugcagcccccucgagugccgcaccuucuuccugacccagggcgcccugcucaacgacaagcacucgaacgggaccaucaaggaccgguccccguaccgcacgcugaugagcugccccaucggcgaggugcccucccccuacaacagccgguucgagagcgucgccugguccgcgagcgccugccacgacgggaucaacuggcugaccaucggcaucuccggcccggacucgggggccguggccgugcucaaguacaacggcaucaucaccgacaccaucaaguccuggcgcaacgacauccugcggacgcaggagagcgagugcgcgugcgucaacggguccugcuucaccaucaugaccgacggccccagcgacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgcccguggguguccuucaaccagaaccuggaguaccagaucggguacaucugcucgggcaucuucggggacaacccccggcccaacgacaagaccggcuccugcggccccgugagcuccaacggggccaacggcgucaagggguucagcuucaaguacggcaacgggguguggaucggccgcaccaagagcaucuccagccggaagggcuucgagaugaucugggacccgaacggguggaccggcaccgacaacaacuucuccaucaagcaggacaucguggggaucaacgaguggucgggcuacuccgggagcuucguccagcaccccgagcucacgggccuggacugcauccgccccugcuucuggguggagcugauccggggccgccccaaggagaacaccaucuggaccuccgggagcuccaucagcuucugcggcgucaacuccgacaccgugggguggagcuggccggacggcgccgagcuccccuucacgaucgacaaguga

SEQ ID NO: 27779 - RNA, 1410 nt, Artificial Sequence; identical to SEQ ID NO: 16339
  derived and/or modified CDS sequence (AUadapt) from InfluenzaA__AHZ40609__NA

SEQ ID NO: 27780 - RNA, 1410 nt, Artificial Sequence; identical to SEQ ID NO: 25777
  derived and/or modified CDS sequence (AUadapt) from InfluenzaA__AHZ40629__NA

SEQ ID NO: 27781 - RNA, 1410 nt, Artificial Sequence; identical to SEQ ID NO: 25759
  derived and/or modified CDS sequence (AUadapt) from InfluenzaA__AHZ40641__NA

SEQ ID NO: 27782 - RNA, 1410 nt, Artificial Sequence
  derived and/or modified CDS sequence (AUadapt) from InfluenzaA__AHZ40653__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccggguaccggaacuggagcaagccccagugcggcaucaccggguucgcgcccuucuccaaggacaacucgauccgccuguccgccggcggggacaucugggucacccgggagcccuacgugagcugcgacccggacaagugcuaccaguucgcccugggccagggcaccacgcucaacaacgugcacuccaacaacaccguccgcgaccggacccccuaccgcacccugcugaugaacgagcucggggugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggcuccgccagcgggaaggccgacaccaagauccuguucaucgaggagggcaagaucgugcacacgucgacccucuccgggucggcgcagcacguggaggagugcuccugcuacccccgguacccgggcguccgcugcgugugccgggacaacuggaagggcagcaaccgccccaucguggacaucaacaucaaggaccacuccaucgucucguccuacgugugcagcgggcuggugggcgacaccccgcggaagaacgacuccucguccagcucccacugccuggaccccaacaacgaggagggcgggcacggggucaagggcugggccuucgacgacggcaacgacguguggauggggcgcaccaucaacgagacgucgcggcucggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcccaucuga

SEQ ID NO: 27783 - RNA, 1410 nt, Artificial Sequence; identical to SEQ ID NO: 25777
  derived and/or modified CDS sequence (AUadapt) from InfluenzaA__AHZ40665__NA

SEQ ID NO: 27784 - RNA, 1410 nt, Artificial Sequence; identical to SEQ ID NO: 25777
  derived and/or modified CDS sequence (AUadapt) from InfluenzaA__AHZ40677__NA

SEQ ID NO: 27785 - RNA, 1410 nt, Artificial Sequence; identical to SEQ ID NO: 16339
  derived and/or modified CDS sequence (AUadapt) from InfluenzaA__AHZ40689__NA

SEQ ID NO: 27786 - RNA, 1410 nt, Artificial Sequence
  derived and/or modified CDS sequence (AUadapt) from InfluenzaA__AHZ40713__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggacaaguccggcuacucggggaucuucuccgucgagggcaagagcugcaucaaccggugcuucuacguggagcugauccggggccgcaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27787 - RNA, 1410 nt, Artificial Sequence
  derived and/or modified CDS sequence (AUadapt) from InfluenzaA__AHZ40725__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggagauccugcgcacccaggagagcgagugcgugugcaucaacgggacgugcaccguggucaugaccgacggcuccgccucgggcaaggccgacaccaagauccuguucaucgaggaggggaagaucgugcacacgagcacccucuccggcucggcgcagcacguggaggagugcuccugcuacccccgguacccggggguccgcugcgugugccgggacaacuggaagggcucgaaccgccccaucguggacaucaacaucaaggaccacuccaucgucagcggcuacgugugcuccgggcuggugggcgacacgccccggaagaacgacucguccagcuccucgcacugccuggaccccaacaacgaggagggcgggcacggggucaagggcugggccuucgacgacggcaacgacguguggauggggcgcaccaucaacgagaccucccggcucggcuacgagaccuucaaggucaucgagggguggucgaacccgaaguccaagcugcagaucaaccgccaggugaucguggaccggggcgaccgcagcggguacuccggcaucuucucggucgagggcaaguccugcaucaaccggugcuucuacguggagcugauccgcgggcggaaggaggagaccgaggugcucuggaccagcaacucgaucgucguguucugcggcacguccgggaccuacggcaccgggagcuggcccgacggcgccgaccugaaccugaugcccaucuga

SEQ ID NO: 27788 - RNA, 1410 nt, Artificial Sequence; identical to SEQ ID NO: 25766
  derived and/or modified CDS sequence (AUadapt) from InfluenzaA__AHZ40737__NA

SEQ ID NO: 27789 - RNA, 1410 nt, Artificial Sequence
  derived and/or modified CDS sequence (AUadapt) from InfluenzaA__AHZ40749__NA
augaaccccaaccagaagaucaucaccaucggcucggugucccugaccaucucgacgaucugccucuucaugcagaucgccauccugaucaccaccgucacccugcacuucaagcaguacgaguucaacuccccgcccaacaaccaggugaugcucugcgagcccacgaucaucgagcgcaacaucaccgagaucguguaccugaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugucgugcgacccggacaagugcuaccaguucgcccucgggcagggcaccacgcugaacaacgugcacuccaacaacaccguccgcgaccggacccccuaccgcacccugcucaugaacgagcugggcgugcccuuccaccuggggacgaagcaggucugcaucgccuggagcuccucguccugccacgacggcaaggccuggcuccacgugugcaucaccggggacgacaagaacgcgaccgccagcuucaucuacaacggccggcugguggacuccguggucucgugguccaaggagauccugcgcacccaggagucggagugcgugugcaucaacgggacgugcaccguggucaugaccgacggcuccgccagcggcaaggccgacaccaagauccucuucaucgaggaggggaagaucgugcacacgucgacccuguccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccucgucccacugccucgaccccaacaacgaggagggcgggcacggcgucaaggggugggccuucgacgacggcaacgacguguggaugggccgcaccaucaacgagacgagccggcugggguacgagaccuucaaggucaucgagggcugguccaaccccaagucgaagcugcagaucaaccgccaggugaucguggaccgcggggaccgguccggcuacucggggaucuucuccgucgagggcaagagcugcaucaaccggugcuucuacguggagcucauccgcggccggaaggaggagaccgaggugcuguggaccucgaacuccaucgucguguucugcgggacgagcggcaccuacgggaccggccccuggcccgacggggccgaccugaaccucaugcccaucuga

SEQ ID NO: 27790 - RNA, 1410 nt, Artificial Sequence
  derived and/or modified CDS sequence (AUadapt) from InfluenzaA__AHZ40761__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagcugugccccaagcuggccgaguaccggaacuggucgaagccgcagugcgacaucaccggguucgcgcccuucuccaaggacaacagcauccgccucuccgccggcggggacaucugggucacccgggagcccuacgugucgugcgaccccgacaagugcuaccaguucgcccugggccaggggaccacgcugaacaacgugcacuccaacaacaccguccgcgaccggaccccguaccgcacccuccugaugaacgagcugggcgugcccuuccaccucggcacgaagcaggucugcauggccuggagcuccucguccugccacgacgggaaggccuggcugcacgugugcaucaccggcgacgacaagaacgcgaccgccagcuucaucuacaacgggaagcugguggacuccguggucucgugguccaaggagauccuccggacccaggagagcgagugcgugugcaucaacggcacgugcaccguggucaugaccgacggguccgccucgggcaaggccgacaccaagauccuguucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccucgugggcgacacgccccgcaagaccgacuccucguccagcucccacugccuggaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcuccagaucaaccgccaggugaucguggaccggggcgaccgguccggguacucgggcaucuucuccgucgagggcaagagcugcaucaaccgcugcuucuacguggagcugauccgggggcgcaagaaggagaccgccgugcuguggacgucgaacuccaucgucguguucugcggcaccagcgggaccuacggcaccggguccuggccggacggcgccgaccucaaccugaugcccaucuga

SEQ ID NO: 27791 - RNA, 1410 nt, Artificial Sequence; identical to SEQ ID NO: 16339
  derived and/or modified CDS sequence (AUadapt) from InfluenzaA__AHZ40773__NA

SEQ ID NO: 27792 - RNA, 1410 nt, Artificial Sequence; identical to SEQ ID NO: 16274
  derived and/or modified CDS sequence (AUadapt) from InfluenzaA__AHZ40785__NA

SEQ ID NO: 27793 - RNA, 1410 nt, Artificial Sequence; identical to SEQ ID NO: 16274
  derived and/or modified CDS sequence (AUadapt) from InfluenzaA__AHZ40796__NA

SEQ ID NO: 27794 - RNA, 1410 nt, Artificial Sequence; identical to SEQ ID NO: 16274
  derived and/or modified CDS sequence (AUadapt) from InfluenzaA__AHZ40807__NA

SEQ ID NO: 27795 - RNA, 1410 nt, Artificial Sequence; identical to SEQ ID NO: 16274
  derived and/or modified CDS sequence (AUadapt) from InfluenzaA__AHZ40818__NA

SEQ ID NO: 27796 - RNA, 1410 nt, Artificial Sequence; identical to SEQ ID NO: 16274
  derived and/or modified CDS sequence (AUadapt) from InfluenzaA__AHZ40829__NA

SEQ ID NO: 27797 - RNA, 1410 nt, Artificial Sequence; identical to SEQ ID NO: 16274
  derived and/or modified CDS sequence (AUadapt) from InfluenzaA__AHZ40840__NA

SEQ ID NO: 27798 - RNA, 1410 nt, Artificial Sequence; identical to SEQ ID NO: 16274
  derived and/or modified CDS sequence (AUadapt) from InfluenzaA__AHZ40851__NA

SEQ ID NO: 27799 - RNA, 1410 nt, Artificial Sequence; identical to SEQ ID NO: 16274
  derived and/or modified CDS sequence (AUadapt) from InfluenzaA__AHZ40862__NA

SEQ ID NO: 27800 - RNA, 1410 nt, Artificial Sequence; identical to SEQ ID NO: 16274
  derived and/or modified CDS sequence (AUadapt) from InfluenzaA__AHZ40873__NA

SEQ ID NO: 27801 - RNA, 1410 nt, Artificial Sequence; identical to SEQ ID NO: 16274
  derived and/or modified CDS sequence (AUadapt) from InfluenzaA__AHZ40884__NA

SEQ ID NO: 27802 - RNA, 1410 nt, Artificial Sequence; identical to SEQ ID NO: 16274
  derived and/or modified CDS sequence (AUadapt) from InfluenzaA__AHZ40895__NA

SEQ ID NO: 27803 - RNA, 1410 nt, Artificial Sequence; identical to SEQ ID NO: 16274
  derived and/or modified CDS sequence (AUadapt) from InfluenzaA__AHZ40906__NA

SEQ ID NO: 27804 - RNA, 1410 nt, Artificial Sequence; identical to SEQ ID NO: 16274
  derived and/or modified CDS sequence (AUadapt) from InfluenzaA__AHZ40917__NA

SEQ ID NO: 27805 - RNA, 1410 nt, Artificial Sequence; identical to SEQ ID NO: 16274
  derived and/or modified CDS sequence (AUadapt) from InfluenzaA__AHZ40928__NA

SEQ ID NO: 27806 - RNA, 1410 nt, Artificial Sequence; identical to SEQ ID NO: 16274
  derived and/or modified CDS sequence (AUadapt) from InfluenzaA__AHZ40939__NA

SEQ ID NO: 27807 - RNA, 1410 nt, Artificial Sequence; identical to SEQ ID NO: 16274
  derived and/or modified CDS sequence (AUadapt) from InfluenzaA__AHZ40950__NA

SEQ ID NO: 27808 - RNA, 1410 nt, Artificial Sequence; identical to SEQ ID NO: 16274
  derived and/or modified CDS sequence (AUadapt) from InfluenzaA__AHZ40961__NA

SEQ ID NO: 27809 - RNA, 1410 nt, Artificial Sequence; identical to SEQ ID NO: 16274
  derived and/or modified CDS sequence (AUadapt) from InfluenzaA__AHZ40972__NA

SEQ ID NO: 27810 - RNA, 1410 nt, Artificial Sequence; identical to SEQ ID NO: 16274
  derived and/or modified CDS sequence (AUadapt) from InfluenzaA__AHZ40983__NA

SEQ ID NO: 27811 - RNA, 1410 nt, Artificial Sequence; identical to SEQ ID NO: 16274
  derived and/or modified CDS sequence (AUadapt) from InfluenzaA__AHZ40994__NA

SEQ ID NO: 27812 - RNA, 1410 nt, Artificial Sequence; identical to SEQ ID NO: 16274
  derived and/or modified CDS sequence (AUadapt) from InfluenzaA__AHZ41005__NA

SEQ ID NO: 27813 - RNA, 1410 nt, Artificial Sequence; identical to SEQ ID NO: 16274
  derived and/or modified CDS sequence (AUadapt) from InfluenzaA__AHZ41016__NA

SEQ ID NO: 27814 - RNA, 1410 nt, Artificial Sequence; identical to SEQ ID NO: 16274
  derived and/or modified CDS sequence (AUadapt) from InfluenzaA__AHZ41027__NA

SEQ ID NO: 27815 - RNA, 1410 nt, Artificial Sequence; identical to SEQ ID NO: 16274
  derived and/or modified CDS sequence (AUadapt) from InfluenzaA__AHZ41049__NA

SEQ ID NO: 27816 - RNA, 1410 nt, Artificial Sequence; identical to SEQ ID NO: 16274
  derived and/or modified CDS sequence (AUadapt) from InfluenzaA__AHZ41060__NA

SEQ ID NO: 27817 - RNA, 1410 nt, Artificial Sequence; identical to SEQ ID NO: 16274
  derived and/or modified CDS sequence (AUadapt) from InfluenzaA__AHZ41071__NA

SEQ ID NO: 27818 - RNA, 1410 nt, Artificial Sequence; identical to SEQ ID NO: 16274
  derived and/or modified CDS sequence (AUadapt) from InfluenzaA__AHZ41082__NA

SEQ ID NO: 27819 - RNA, 1410 nt, Artificial Sequence; identical to SEQ ID NO: 16274
  derived and/or modified CDS sequence (AUadapt) from InfluenzaA__AHZ41093__NA

SEQ ID NO: 27820 - RNA, 1410 nt, Artificial Sequence; identical to SEQ ID NO: 16274
  derived and/or modified CDS sequence (AUadapt) from InfluenzaA__AHZ41104__NA

SEQ ID NO: 27821 - RNA, 1410 nt, Artificial Sequence; identical to SEQ ID NO: 16274
  derived and/or modified CDS sequence (AUadapt) from InfluenzaA__AHZ41115__NA

SEQ ID NO: 27822 - RNA, 1410 nt, Artificial Sequence; identical to SEQ ID NO: 16274
  derived and/or modified CDS sequence (AUadapt) from InfluenzaA__AHZ41126__NA

SEQ ID NO: 27823 - RNA, 1410 nt, Artificial Sequence; identical to SEQ ID NO: 16274
  derived and/or modified CDS sequence (AUadapt) from InfluenzaA__AHZ41137__NA

SEQ ID NO: 27824 - RNA, 1410 nt, Artificial Sequence; identical to SEQ ID NO: 16274
  derived and/or modified CDS sequence (AUadapt) from InfluenzaA__AHZ41148__NA

SEQ ID NO: 27825 - RNA, 1410 nt, Artificial Sequence; identical to SEQ ID NO: 16274
  derived and/or modified CDS sequence (AUadapt) from InfluenzaA__AHZ41159__NA

SEQ ID NO: 27826 - RNA, 1410 nt, Artificial Sequence; identical to SEQ ID NO: 16274
  derived and/or modified CDS sequence (AUadapt) from InfluenzaA__AHZ41170__NA

SEQ ID NO: 27827 - RNA, 1410 nt, Artificial Sequence; identical to SEQ ID NO: 16274
  derived and/or modified CDS sequence (AUadapt) from InfluenzaA__AHZ41181__NA

SEQ ID NO: 27828 - RNA, 1410 nt, Artificial Sequence; identical to SEQ ID NO: 16274
  derived and/or modified CDS sequence (AUadapt) from InfluenzaA__AHZ41205__NA

SEQ ID NO: 27829 - RNA, 1410 nt, Artificial Sequence; identical to SEQ ID NO: 16274
  derived and/or modified CDS sequence (AUadapt) from InfluenzaA__AHZ41251__NA

SEQ ID NO: 27830 - RNA, 1410 nt, Artificial Sequence; identical to SEQ ID NO: 16274
  derived and/or modified CDS sequence (AUadapt) from InfluenzaA__AHZ41266__NA

SEQ ID NO: 27831 - RNA, 1410 nt, Artificial Sequence; identical to SEQ ID NO: 16274
  derived and/or modified CDS sequence (AUadapt) from InfluenzaA__AHZ41284__NA

SEQ ID NO: 27832 - RNA, 1410 nt, Artificial Sequence; identical to SEQ ID NO: 16274
  derived and/or modified CDS sequence (AUadapt) from InfluenzaA__AHZ41295__NA

SEQ ID NO: 27833 - RNA, 1410 nt, Artificial Sequence; identical to SEQ ID NO: 16274
  derived and/or modified CDS sequence (AUadapt) from InfluenzaA__AHZ41306__NA

SEQ ID NO: 27834 - RNA, 1410 nt, Artificial Sequence; identical to SEQ ID NO: 16274
  derived and/or modified CDS sequence (AUadapt) from InfluenzaA__AHZ41317__NA

SEQ ID NO: 27835 - RNA, 1410 nt, Artificial Sequence; identical to SEQ ID NO: 16274
  derived and/or modified CDS sequence (AUadapt) from InfluenzaA__AHZ41328__NA

SEQ ID NO: 27836 - RNA, 1410 nt, Artificial Sequence; identical to SEQ ID NO: 16274
  derived and/or modified CDS sequence (AUadapt) from InfluenzaA__AHZ41339__NA

SEQ ID NO: 27837 - RNA, 1410 nt, Artificial Sequence; identical to SEQ ID NO: 16274
  derived and/or modified CDS sequence (AUadapt) from InfluenzaA__AHZ41350__NA

SEQ ID NO: 27838 - RNA, 1410 nt, Artificial Sequence; identical to SEQ ID NO: 16274
  derived and/or modified CDS sequence (AUadapt) from InfluenzaA__AHZ41369__NA

SEQ ID NO: 27839 - RNA, 1410 nt, Artificial Sequence; identical to SEQ ID NO: 16274
  derived and/or modified CDS sequence (AUadapt) from InfluenzaA__AHZ41380__NA

SEQ ID NO: 27840 - RNA, 1410 nt, Artificial Sequence; identical to SEQ ID NO: 16274
  derived and/or modified CDS sequence (AUadapt) from InfluenzaA__AHZ41391__NA

SEQ ID NO: 27841 - RNA, 1410 nt, Artificial Sequence; identical to SEQ ID NO: 16274
  derived and/or modified CDS sequence (AUadapt) from InfluenzaA__AHZ41402__NA

SEQ ID NO: 27842 - RNA, 1410 nt, Artificial Sequence; identical to SEQ ID NO: 16274
  derived and/or modified CDS sequence (AUadapt) from InfluenzaA__AHZ41413__NA

SEQ ID NO: 27843 - RNA, 1410 nt, Artificial Sequence; identical to SEQ ID NO: 16274
  derived and/or modified CDS sequence (AUadapt) from InfluenzaA__AHZ41444__NA

SEQ ID NO: 27844 - RNA, 1410 nt, Artificial Sequence; identical to SEQ ID NO: 16274
  derived and/or modified CDS sequence (AUadapt) from InfluenzaA__AHZ41455__NA

SEQ ID NO: 27845 - RNA, 1410 nt, Artificial Sequence; identical to SEQ ID NO: 16274
  derived and/or modified CDS sequence (AUadapt) from InfluenzaA__AHZ41476__NA

SEQ ID NO: 27846 - RNA, 1410 nt, Artificial Sequence; identical to SEQ ID NO: 16274
  derived and/or modified CDS sequence (AUadapt) from InfluenzaA__AHZ41487__NA

SEQ ID NO: 27847 - RNA, 1410 nt, Artificial Sequence; identical to SEQ ID NO: 16274
  derived and/or modified CDS sequence (AUadapt) from InfluenzaA__AHZ41498__NA

SEQ ID NO: 27848 - RNA, 1410 nt, Artificial Sequence; identical to SEQ ID NO: 16274
  derived and/or modified CDS sequence (AUadapt) from InfluenzaA__AHZ41509__NA

SEQ ID NO: 27849 - RNA, 1410 nt, Artificial Sequence; identical to SEQ ID NO: 16274
  derived and/or modified CDS sequence (AUadapt) from InfluenzaA__AHZ41520__NA

SEQ ID NO: 27850 - RNA, 1410 nt, Artificial Sequence; identical to SEQ ID NO: 16274
  derived and/or modified CDS sequence (AUadapt) from InfluenzaA__AHZ41531__NA

SEQ ID NO: 27851 - RNA, 1410 nt, Artificial Sequence; identical to SEQ ID NO: 16274
  derived and/or modified CDS sequence (AUadapt) from InfluenzaA__AHZ41542__NA

SEQ ID NO: 27852 - RNA, 1410 nt, Artificial Sequence; identical to SEQ ID NO: 16274
  derived and/or modified CDS sequence (AUadapt) from InfluenzaA__AHZ41553__NA

SEQ ID NO: 27853 - RNA, 1410 nt, Artificial Sequence; identical to SEQ ID NO: 16274
  derived and/or modified CDS sequence (AUadapt) from InfluenzaA__AHZ41564__NA

SEQ ID NO: 27854 - RNA, 1410 nt, Artificial Sequence; identical to SEQ ID NO: 16274
  derived and/or modified CDS sequence (AUadapt) from InfluenzaA__AHZ41586__NA

SEQ ID NO: 27855 - RNA, 1410 nt, Artificial Sequence; identical to SEQ ID NO: 16274
  derived and/or modified CDS sequence (AUadapt) from InfluenzaA__AHZ41597__NA

SEQ ID NO: 27856 - RNA, 1410 nt, Artificial Sequence; identical to SEQ ID NO: 16274
  derived and/or modified CDS sequence (AUadapt) from InfluenzaA__AHZ41608__NA

SEQ ID NO: 27857 - RNA, 1410 nt, Artificial Sequence; identical to SEQ ID NO: 16274
  derived and/or modified CDS sequence (AUadapt) from InfluenzaA__AHZ41619__NA

SEQ ID NO: 27858 - RNA, 1410 nt, Artificial Sequence; identical to SEQ ID NO: 16274
  derived and/or modified CDS sequence (AUadapt) from InfluenzaA__AHZ41630__NA

SEQ ID NO: 27859 - RNA, 1410 nt, Artificial Sequence; identical to SEQ ID NO: 16274
  derived and/or modified CDS sequence (AUadapt) from InfluenzaA__AHZ41641__NA

SEQ ID NO: 27860 - RNA, 1410 nt, Artificial Sequence; identical to SEQ ID NO: 16274
  derived and/or modified CDS sequence (AUadapt) from InfluenzaA__AHZ41652__NA

SEQ ID NO: 27861 - RNA, 1410 nt, Artificial Sequence; identical to SEQ ID NO: 16274
  derived and/or modified CDS sequence (AUadapt) from InfluenzaA__AHZ41663__NA

SEQ ID NO: 27862 - RNA, 1410 nt, Artificial Sequence; identical to SEQ ID NO: 16274
  derived and/or modified CDS sequence (AUadapt) from InfluenzaA__AHZ41674__NA

SEQ ID NO: 27863 - RNA, 1410 nt, Artificial Sequence; identical to SEQ ID NO: 16274
  derived and/or modified CDS sequence (AUadapt) from InfluenzaA__AHZ41685__NA

SEQ ID NO: 27864 - RNA, 1410 nt, Artificial Sequence; identical to SEQ ID NO: 16274
  derived and/or modified CDS sequence (AUadapt) from InfluenzaA__AHZ41696__NA

SEQ ID NO: 27865 - RNA, 1410 nt, Artificial Sequence; identical to SEQ ID NO: 16274
  derived and/or modified CDS sequence (AUadapt) from InfluenzaA__AHZ41707__NA

SEQ ID NO: 27866 - RNA, 1410 nt, Artificial Sequence; identical to SEQ ID NO: 16274
  derived and/or modified CDS sequence (AUadapt) from InfluenzaA__AHZ41718__NA

SEQ ID NO: 27867 - RNA, 1410 nt, Artificial Sequence; identical to SEQ ID NO: 16274
  derived and/or modified CDS sequence (AUadapt) from InfluenzaA__AHZ41729__NA

SEQ ID NO: 27868 - RNA, 1410 nt, Artificial Sequence; identical to SEQ ID NO: 16274
  derived and/or modified CDS sequence (AUadapt) from InfluenzaA__AHZ41740__NA

SEQ ID NO: 27869 - RNA, 1410 nt, Artificial Sequence; identical to SEQ ID NO: 16274
  derived and/or modified CDS sequence (AUadapt) from InfluenzaA__AHZ41751__NA

SEQ ID NO: 27870 - RNA, 1410 nt, Artificial Sequence; identical to SEQ ID NO: 16274
  derived and/or modified CDS sequence (AUadapt) from InfluenzaA__AHZ41762__NA

SEQ ID NO: 27871 - RNA, 1410 nt, Artificial Sequence; identical to SEQ ID NO: 25791
  derived and/or modified CDS sequence (AUadapt) from InfluenzaA__AHZ42564__NA

SEQ ID NO: 27872 - RNA, 1410 nt, Artificial Sequence; identical to SEQ ID NO: 16339
  derived and/or modified CDS sequence (AUadapt) from InfluenzaA__AHZ42575__NA

SEQ ID NO: 27873 - RNA, 1410 nt, Artificial Sequence
  derived and/or modified CDS sequence (AUadapt) from InfluenzaA__AHZ42587__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaugugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27874 - RNA, 1413 nt, Artificial Sequence
  derived and/or modified CDS sequence (AUadapt) from InfluenzaA__AHZ42599__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaagaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcgagaaggccgacaccaagauccuguucaucgaggagggcaagaucgugcacacgucgacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcgggcacggggucaagggcugggccuucgacgacgggaacgacguguggaugggccgcaccaucaacgagacgucgcggcucggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcccaucuga

SEQ ID NO: 27875 - RNA, 1410 nt, Artificial Sequence; identical to SEQ ID NO: 27194
  derived and/or modified CDS sequence (AUadapt) from InfluenzaA__AHZ42611__NA

SEQ ID NO: 27876 - RNA, 1410 nt, Artificial Sequence; identical to SEQ ID NO: 16339
  derived and/or modified CDS sequence (AUadapt) from InfluenzaA__AHZ42622__NA

SEQ ID NO: 27877 - RNA, 1410 nt, Artificial Sequence; identical to SEQ ID NO: 27735
  derived and/or modified CDS sequence (AUadapt) from InfluenzaA__AHZ42634__NA

SEQ ID NO: 27878 - RNA, 1410 nt, Artificial Sequence; identical to SEQ ID NO: 27778
  derived and/or modified CDS sequence (AUadapt) from InfluenzaA__AHZ42646__NA

SEQ ID NO: 27879 - RNA, 1410 nt, Artificial Sequence; identical to SEQ ID NO: 16339
  derived and/or modified CDS sequence (AUadapt) from InfluenzaA__AHZ42657__NA

SEQ ID NO: 27880 - RNA, 1410 nt, Artificial Sequence; identical to SEQ ID NO: 27495
  derived and/or modified CDS sequence (AUadapt) from InfluenzaA__AHZ42669__NA

SEQ ID NO: 27881 - RNA, 1410 nt, Artificial Sequence; identical to SEQ ID NO: 16339
  derived and/or modified CDS sequence (AUadapt) from InfluenzaA__AHZ42681__NA

SEQ ID NO: 27882 - RNA, 1410 nt, Artificial Sequence
  derived and/or modified CDS sequence (AUadapt) from InfluenzaA__AHZ42693__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacucgcgguucgaguccguggccuggagcgcguccgccugccacgacgggaucaacuggcucaccaucggcaucagcggccccgacuccggggccgucgccgugcugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucagcuucaaguacggcaacggggucuggaucggccgcaccaaguccaucucgucccggaagggcuucgagaugaucugggaccccaacggguggaccggcaccgacaacaacuucagcaucaagcaggacaucguggggaucaacgagugguccggcuacagcggguccuucgugcagcacccggagcugacgggcauggacugcauccgccccugcuucugggucgagcugauccggggccgccccaaggagaacaccaucuggaccagcggguccaucaucagcuucugcggcgugaacuccgacaccgucggguggagcuggcccgacggcgccgagcucccguucacgaucgacaaguga

SEQ ID NO: 27883 - RNA, 1410 nt, Artificial Sequence; identical to SEQ ID NO: 16339
  derived and/or modified CDS sequence (AUadapt) from InfluenzaA__AHZ42704__NA

SEQ ID NO: 27884 - RNA, 1410 nt, Artificial Sequence
  derived and/or modified CDS sequence (AUadapt) from InfluenzaA__AHZ42716__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggucgaagccccagugcgggaucaccggcuucgcgcccuucuccaaggacaacagcauccgccuguccgccgggggcgacaucugggucacccgggagcccuacgugucgugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccucguccugccacgacggcaaggccuggcugcacgugugcaucaccggggacgacaagaacgcgaccgccagcuucaucuacaacggccggcucguggacuccguggucucgugguccaaggagauccugcgcacccaggagagcgagugcgugugcaucaacgggacgugcaccguggucaugaccgacggcuccgccucgggcaaggccgacaccaagauccuguucaucgaggaggggaagaucgugcacacgagcacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaaguuccagaucaaccgccaggugaucguggaccgcggggaccgguccggcuacucggggaucuucuccgucgagggcaagagcugcaucaaccggugcuucuacguggagcugauccgcggccggaaggaggagaccgaggugcuguggaccucgaacuccaucgucguguucugcgggacgagcggcaccuacgggaccggcuccuggcccgacggggccgaccucaaccugaugcccaucuga

SEQ ID NO: 27885 - RNA, 1410 nt, Artificial Sequence; identical to SEQ ID NO: 16339
  derived and/or modified CDS sequence (AUadapt) from InfluenzaA__AHZ42728__NA

SEQ ID NO: 27886 - RNA, 1410 nt, Artificial Sequence; identical to SEQ ID NO: 25791
  derived and/or modified CDS sequence (AUadapt) from InfluenzaA__AHZ42740__NA

SEQ ID NO: 27887 - RNA, 1410 nt, Artificial Sequence; identical to SEQ ID NO: 25759
  derived and/or modified CDS sequence (AUadapt) from InfluenzaA__AHZ42751__NA

SEQ ID NO: 27888 - RNA, 1410 nt, Artificial Sequence
  derived and/or modified CDS sequence (AUadapt) from InfluenzaA__AHZ42763__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucguguacacgucgacccucuccgggucggcgcagcacguggaggagugcuccugcuacccccgguacccgggcguccgcugcgugugccgggacaacuggaaggggagcaaccgccccaucguggacaucaacaucaaggaccacuccaucgucucgcgguacgugugcuccggccuggugggcgacacgccccgcaagaacgacagcuccucguccagccacugccuggaccccaacaacgaggagggcgggcacggggucaagggcugggccuucgacgacgggaacgacguguggaugggccggaccaucaacgagaccucccgccucggcuacgagaccuucaaggucaucgagggguggucgaacccgaaguccaagcugcagaucaaccgccaggugaucguggaccggggcgaccggagcggguacuccggcaucuucucggucgaggggaaguccugcaucaaccgcugcuucuacguggagcugauccggggccgcaaggaggagaccgaggugcucuggaccagcaacucgaucgucguguucugcggcacguccgggaccuacggcaccgggagcuggcccgacggcgccgaccugaaccugaugcccaucuga

SEQ ID NO: 27889 - RNA, 1410 nt, Artificial Sequence; identical to SEQ ID NO: 25777
  derived and/or modified CDS sequence (AUadapt) from InfluenzaA__AHZ42775__NA

SEQ ID NO: 27890 - RNA, 1410 nt, Artificial Sequence; identical to SEQ ID NO: 16339
  derived and/or modified CDS sequence (AUadapt) from InfluenzaA__AHZ42787__NA

SEQ ID NO: 27891 - RNA, 1410 nt, Artificial Sequence
  derived and/or modified CDS sequence (AUadapt) from InfluenzaA__AHZ42799__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucaucgacaucaacaucaaggaccacuccaucgugucguccuacgucugcagcggccuggugggggacaccccgcggaagaacgacuccucguccagcucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggucaucguggaccgcggggaccgguccggcuacucggggaucuucuccguggagggcaagagcugcaucaaccggugcuucuacgucgagcugauccgcggccggaaggaggagaccgaggugcucuggaccucgaacuccaucguggucuucugcgggacgagcggcaccuacgggaccggcuccuggcccgacggggccgaccugaaccugaugcccaucuga

SEQ ID NO: 27892 - RNA, 1410 nt, Artificial Sequence
  derived and/or modified CDS sequence (AUadapt) from InfluenzaA__AHZ42811__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggggcggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcccaucuga

SEQ ID NO: 27893 - RNA, 1410 nt, Artificial Sequence
  derived and/or modified CDS sequence (AUadapt) from InfluenzaA__AHZ42823__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcggagcaguccgucgugagcgugaagcuggccggcaacuccucgcucugcccggucuccgggugggccaucuacagcaaggacaacuccgugcgcaucggcagcaagggcgacguguucgucauccgggagcccuucaucuccugcagcccccuggagugccgcaccuucuuccugacccagggggcccuccugaacgacaagcacuccaacggcaccaucaaggaccggagccccuaccgcacgcugauguccugcccgaucggggaggugcccagccccuacaacucgcgguucgaguccguggccuggagcgcguccgccugccacgacggcaucaacuggcucaccaucgggaucagcggccccgacuccggcgccgucgccgugcugaaguacaacgggaucaucaccgacaccaucaagagcuggcgcaacaacauccugcggacgcaggaguccgagugcgcgugcgugaacggcagcugcuucaccaucaugaccgacgggccguccgacggccaggccagcuacaagaucuuccgcaucgagaagggcaagaucgucaaguccguggagaugaacgcccccaacuaccacuacgaggagugcucgugcuaccccgacuccagcgagaucacgugcgugugccgggacaacuggcacggguccaaccgccccugggucagcuucaaccagaaccucgaguaccagaucggcuacaucugcuccgggaucuucggcgacaacccgcggcccaacgacaagaccgggagcugcggccccguguccagcaacggcgccaacggggugaagggcuucagcuucaaguacgggaacggcgucuggaucgggcgcaccaaguccaucucgucccggaagggcuucgagaugaucugggaccccaacggcuggaccgggaccgacaacaacuucagcaucaagcaggacaucgugggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 27894 - RNA, 1410 nt, Artificial Sequence
  derived and/or modified CDS sequence (AUadapt) from InfluenzaA__AHZ42834__NA
augaaccccaaccagaagaucaucaccaucggcucggugucccugaccaucucgacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcacgacccucaacaacgugcacuccaacaacaccguccgcgaccggacccccuaccgcacgcugcugaugaacgagcucggcgugcccuuccaccuggggaccaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggagauccugcgcacgcaggagagcgagugcgugugcaucaacgggaccugcaccguggucaugaccgacggcuccgccucgggcaaggccgacacgaagauccuguucaucgaggaggggaagaucgugcacaccagcacccucuccggcucggcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacaccccgcggaagaacgacuccagcuccucgucccacugccuggaccccaacaacgaggagggcgggcacggcgucaaggggugggccuucgacgacggcaacgacguguggaugggccgcacgaucaacgagaccucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggacgucgaacuccaucgucguguucugcgggaccagcggcaccuacgggaccggcuccuggcccgacggggccgaccugaaccugaugcccaucuga

SEQ ID NO: 27895 - RNA, 1410 nt, Artificial Sequence; identical to SEQ ID NO: 16339
  derived and/or modified CDS sequence (AUadapt) from InfluenzaA__AHZ42846__NA

SEQ ID NO: 27896 - RNA, 1410 nt, Artificial Sequence; identical to SEQ ID NO: 16339
  derived and/or modified CDS sequence (AUadapt) from InfluenzaA__AHZ42858__NA

SEQ ID NO: 27897 - RNA, 1410 nt, Artificial Sequence; identical to SEQ ID NO: 16339
  derived and/or modified CDS sequence (AUadapt) from InfluenzaA__AHZ42870__NA

SEQ ID NO: 27898 - RNA, 1410 nt, Artificial Sequence; identical to SEQ ID NO: 16339
  derived and/or modified CDS sequence (AUadapt) from InfluenzaA__AHZ42882__NA

SEQ ID NO: 27899 - RNA, 1410 nt, Artificial Sequence
  derived and/or modified CDS sequence (AUadapt) from InfluenzaA__AHZ42894__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggacaagggggaccgguccggcuacucggggaucuucuccgucgagggcaagagcugcaucaaccgcugcuucuacguggagcugauccggggccgcaaggaggagaccgaggugcucuggaccucgaacuccaucgucguguucugcgggacgagcggcaccuacgggaccggcuccuggcccgacggggccgaccugaaccugaugcccaucuga

SEQ ID NO: 27900 - RNA, 1410 nt, Artificial Sequence; identical to SEQ ID NO: 16339
  derived and/or modified CDS sequence (AUadapt) from InfluenzaA__AHZ42906__NA

SEQ ID NO: 27901 - RNA, 1410 nt, Artificial Sequence; identical to SEQ ID NO: 25777
  derived and/or modified CDS sequence (AUadapt) from InfluenzaA__AHZ42918__NA

SEQ ID NO: 27902 - RNA, 1398 nt, Artificial Sequence; identical to SEQ ID NO: 16294
  derived and/or modified CDS sequence (AUadapt) from InfluenzaA__AHZ59750__NA

SEQ ID NO: 27903 - RNA, 1398 nt, Artificial Sequence; identical to SEQ ID NO: 16294
  derived and/or modified CDS sequence (AUadapt) from InfluenzaA__AHZ59762__NA

SEQ ID NO: 27904 - RNA, 1398 nt, Artificial Sequence; identical to SEQ ID NO: 16294
  derived and/or modified CDS sequence (AUadapt) from InfluenzaA__AHZ59774__NA

SEQ ID NO: 27905 - RNA, 1398 nt, Artificial Sequence; identical to SEQ ID NO: 16294
  derived and/or modified CDS sequence (AUadapt) from InfluenzaA__AHZ59786__NA

SEQ ID NO: 27906 - RNA, 1398 nt, Artificial Sequence; identical to SEQ ID NO: 16294
  derived and/or modified CDS sequence (AUadapt) from InfluenzaA__AHZ59798__NA

SEQ ID NO: 27907 - RNA, 1398 nt, Artificial Sequence; identical to SEQ ID NO: 16294
  derived and/or modified CDS sequence (AUadapt) from InfluenzaA__AHZ59810__NA

SEQ ID NO: 27908 - RNA, 1398 nt, Artificial Sequence; identical to SEQ ID NO: 16294
  derived and/or modified CDS sequence (AUadapt) from InfluenzaA__AHZ59822__NA

SEQ ID NO: 27909 - RNA, 1398 nt, Artificial Sequence; identical to SEQ ID NO: 16294
  derived and/or modified CDS sequence (AUadapt) from InfluenzaA__AHZ59834__NA

SEQ ID NO: 27910 - RNA, 1398 nt, Artificial Sequence; identical to SEQ ID NO: 16294
  derived and/or modified CDS sequence (AUadapt) from InfluenzaA__AHZ59846__NA

SEQ ID NO: 27911 - RNA, 1398 nt, Artificial Sequence; identical to SEQ ID NO: 16294
  derived and/or modified CDS sequence (AUadapt) from InfluenzaA__AHZ59858__NA

SEQ ID NO: 27912 - RNA, 1398 nt, Artificial Sequence; identical to SEQ ID NO: 16294
  derived and/or modified CDS sequence (AUadapt) from InfluenzaA__AHZ59870__NA

SEQ ID NO: 27913 - RNA, 1398 nt, Artificial Sequence; identical to SEQ ID NO: 16294
  derived and/or modified CDS sequence (AUadapt) from InfluenzaA__AHZ59882__NA

SEQ ID NO: 27914 - RNA, 1398 nt, Artificial Sequence; identical to SEQ ID NO: 16294
  derived and/or modified CDS sequence (AUadapt) from InfluenzaA__AHZ59918__NA

SEQ ID NO: 27915 - RNA, 1398 nt, Artificial Sequence; identical to SEQ ID NO: 16294
  derived and/or modified CDS sequence (AUadapt) from InfluenzaA__AHZ59930__NA

SEQ ID NO: 27916 - RNA, 1398 nt, Artificial Sequence; identical to SEQ ID NO: 16294
  derived and/or modified CDS sequence (AUadapt) from InfluenzaA__AHZ59942__NA

SEQ ID NO: 27917 - RNA, 1398 nt, Artificial Sequence; identical to SEQ ID NO: 16294
  derived and/or modified CDS sequence (AUadapt) from InfluenzaA__AHZ59954__NA

SEQ ID NO: 27918 - RNA, 1398 nt, Artificial Sequence; identical to SEQ ID NO: 16294
  derived and/or modified CDS sequence (AUadapt) from InfluenzaA__AHZ59966__NA

SEQ ID NO: 27919 - RNA, 1398 nt, Artificial Sequence; identical to SEQ ID NO: 16294
  derived and/or modified CDS sequence (AUadapt) from InfluenzaA__AHZ59991__NA

SEQ ID NO: 27920 - RNA, 1398 nt, Artificial Sequence; identical to SEQ ID NO: 16294
  derived and/or modified CDS sequence (AUadapt) from InfluenzaA__AHZ60003__NA

SEQ ID NO: 27921 - RNA, 1398 nt, Artificial Sequence; identical to SEQ ID NO: 16294
  derived and/or modified CDS sequence (AUadapt) from InfluenzaA__AHZ60015__NA

SEQ ID NO: 27922 - RNA, 1398 nt, Artificial Sequence; identical to SEQ ID NO: 16294
  derived and/or modified CDS sequence (AUadapt) from InfluenzaA__AHZ60027__NA

SEQ ID NO: 27923 - RNA, 1398 nt, Artificial Sequence; identical to SEQ ID NO: 16294
  derived and/or modified CDS sequence (AUadapt) from InfluenzaA__AHZ60039__NA

SEQ ID NO: 27924 - RNA, 1398 nt, Artificial Sequence; identical to SEQ ID NO: 16294
  derived and/or modified CDS sequence (AUadapt) from InfluenzaA__AHZ60051__NA

SEQ ID NO: 27925 - RNA, 1398 nt, Artificial Sequence; identical to SEQ ID NO: 16294
  derived and/or modified CDS sequence (AUadapt) from InfluenzaA__AHZ60063__NA

SEQ ID NO: 27926 - RNA, 1398 nt, Artificial Sequence; identical to SEQ ID NO: 16294
  derived and/or modified CDS sequence (AUadapt) from InfluenzaA__AHZ60075__NA

SEQ ID NO: 27927 - RNA, 1398 nt, Artificial Sequence; identical to SEQ ID NO: 16294
  derived and/or modified CDS sequence (AUadapt) from InfluenzaA__AHZ60087__NA

SEQ ID NO: 27928 - RNA, 1398 nt, Artificial Sequence; identical to SEQ ID NO: 16294
  derived and/or modified CDS sequence (AUadapt) from InfluenzaA__AHZ60099__NA

SEQ ID NO: 27929 - RNA, 1410 nt, Artificial Sequence; identical to SEQ ID NO: 16339
  derived and/or modified CDS sequence (AUadapt) from InfluenzaA__AHZ60111__NA

SEQ ID NO: 27930 - RNA, 1410 nt, Artificial Sequence; identical to SEQ ID NO: 18804
  derived and/or modified CDS sequence (AUadapt) from InfluenzaA__AIA26299__NA

SEQ ID NO: 27931 - RNA, 1374 nt, Artificial Sequence
  derived and/or modified CDS sequence (AUadapt) from InfluenzaA__AIC64891__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagucggucaucaccuacgagaacaacaccaacuucgccgcgggccaguccguggugagcgucaagcuggccgggaacuccucgcucugcccgguguccggcugggccaucuacagcaaggacaacuccgugcgcaucggcagcaagggggacgucuucgugauccgggagcccuucaucuccugcucgccccuggagugccgcaccuucuuccugacgcagggcgcccuccugaacgacaagcacuccaacgggaccaucaaggaccggagccccuaccgcacccugauguccugcccgaucggcgaggugcccucgcccuacaacucccgguucgagagcgucgccuggucggcguccgccugccacgacgggaucaacuggcucaccaucggcaucagcggccccgacaacggggccguggccgugcugaaguacaacggcaucaucacggacaccaucaaguccuggcgcaacaacauccugcggacccaggagagcgagugcgcgugcgucaacggguccugcuucaccgugaugacggacggcccgucgaacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaaguccaucucgagccggaacggcuucgagaugaucugggaccccaacggguggaccggcaccgacaacaacuucuccaucaagcaggacaucgucgggaucaacgaguggucgggcuacuccgggagcuucgugcagcacccggagcugaccggccuggacugcauccgccccugcuucuggguggagcucauccggggccgccccaaggagaacaccaucuggacguccgggucguccaucagcuucugcggcgucaacuccgacaccgugggguggagcuggcccgacggcgccgagcugccguucaccaucgacaaguga

SEQ ID NO: 27932 - RNA, 1350 nt, Artificial Sequence
  derived and/or modified CDS sequence (AUadapt) from InfluenzaA__AID48084__NA
augaaucccaacaagaagaucaucaccaucggcucgaucugcauggugaccgggauggucucccugaugcuccagaucggcaaccugaucagcaucugggugucccacagcauccauacggggaaccagcacaaggccgagccgaucuccaacaccaaccugcucaccgagaagaccguggccagcgucaagcuggcgggcaacuccagccugugucccaucaacgggugggccguguacuccaaggacaacagcauccgcaucggcuccaagggcgacguguucgucauccgggagcccuuuaucagcugcucccaccucgagugccgcacguucuuccugacccagggggcccugcucaacgauaagcacagcaacggcaccgugaaggaccggagcccccaccgcacccugauguccugcccggugggggaggcccccucccccuauaacucgcgguucgaguccgucgccuggagcgcgagcgccugccacgauggcacguccuggcugaccaucgggaucagcggccccgacaacggcgccguggccgugcucaaguacaacgggaucaucaccgacaccaucaaguccuggcgcaacaauauccugcggacgcaggagagcgagugcgcgugcgucaacggcuccugcuucaccgugaugaccgacgggccgaguaacggccaggccucccacaagaucuucaagauggagaagggcaagguggucaagagcguggagcuggacgcccccaacuaccauuacgaggagugcuccugcuaccccgacgccggggagaucacgugcgugugccgcgauaacuggcacggcagcaaccggcccugggucuccuucaaccagaaccucgaguaucagaucggguacaucugcagcggcguguucggggacaacccgcgccccaacgauggcgccggcuccugcgggcccgugucguccaacggcgcguacggggucaagggcuucagcuucaaguaugggaacggcguguggaucggccggaccaaguccaccaacagccgcuccggguucgagaugaucugggaccccaacggcuggaccgagaccgacaguagcuucuccgugaagcaggacaucgucgccaucacggacuggagcggguacuccggcagcuuugugcagcacccggagcugaccgggcuggacugcauccggcccugcuucugggucgagcucauccgcggccggcccaaggaguccaccaucuggaccagcggcuccagcaucuccuuuugcggggugaacagcgacacggugggcugguccuggcccgacggggccgagcugccguucaccaucgacaaguga

SEQ ID NO: 27933 - RNA, 1410 nt, Artificial Sequence
  derived and/or modified CDS sequence (AUadapt) from InfluenzaA__AID70507__NA
augaaccccaaccagaagaucaucaccaucggcucggugugcaccacgaucgggauggccaaccugauccuccagaucggcaacaucaucuccaucuggaucagccacuccauccagcuggggaaccagaaccagaucgagaccugcaaccagagcgucaucaccuacgagaacaagaccugggugaaccagacguacgugaacaucuccaacaccaacuucgccgcgggccagagcgucguguccgugaagcuggccgggaacagcucccucugcccggucagcggcugggccaucuacuccaaggacaacucgauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacacgaucaagucguggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcgaccccguguccuucaacggcgccaacggggugaagggcuucucguucaaguacgggaacggcgucuggaucgggcgcaccaaguccaucagcagccggaacggcuucgagaugaucugggaccccaacggcuggaccgggacggacaacaaguucuccaucaagcaggacaucgugggcaucaacgaguggagcggguacuccggcagcuucgugcagcacccggagcugaccgggcuggacugcauccgccccugcuucugggucgagcucauccggggccgccccaaggagaacaccaucuggaccuccggcagcuccaucagcuucugcggggugaacuccgacacggucggcugguucuggcccgacggggccgagcugccguucaccaucgacaaguga

SEQ ID NO: 27934 - RNA, 1410 nt, Artificial Sequence
  derived and/or modified CDS sequence (AUadapt) from InfluenzaA__AID70508__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccaacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggucgggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 27935 - RNA, 1410 nt, Artificial Sequence
  derived and/or modified CDS sequence (AUadapt) from InfluenzaA__AID70509__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcucgaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucaacucccggaagggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 27936 - RNA, 1410 nt, Artificial Sequence
  derived and/or modified CDS sequence (AUadapt) from InfluenzaA__AID70510__NA
augaaccccaaccagaagaucaucaccaucggcucggugugcaucaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggucgggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 27937 - RNA, 1410 nt, Artificial Sequence
  derived and/or modified CDS sequence (AUadapt) from InfluenzaA__AID70511__NA
augaaccccaaccagaagaucaucaccaugggcucgguguggaugaccaucgggauggccaaccugauccuccaguccggcaacaucaucagcaucuggaucucccacagcauccagcugcgcaaccagucccagaucgagacgugcaaccagagcgucaucaccuacgagaacaacaccugggugaaccagaccuacgugaacaucuccaacacgaacuucgccgcggggcagucggucguguccgugaagcuggccggcaacagcucccucugcccggucagcgggugggccaucuacuccaaggacaacagcauccggaucggcuccaagggcgacguguucgugauccgcgagcccuucaucagcugcucgccccuggagugccggaccuucuuccugacccagggggcccuccugaacgacaagcacuccaacggcaccaucaaggaccgcucccccuaccggacgcugaugagcugcccgaucggggagguccccagccccuacaacucccgcuucgagagcguggccugguccgcgagcgccugccacgacggcaucaacuggcucaccaucgggaucuccggccccgacaacggcgccguggccguccugaaguacaacgggaucaucaccgacaccaucaagucguggcggaacaacauccugcgcacgcaggaguccgagugcgcgugcgugaacggcagcugcuucaccaucaugaccgacgggccguccgacggccaggccagcuacaagaucuuccggaucgagaagggcaagaucgugaaguccgucgagaugaacgcccccaacuaccacuacgaggagugcagcugcuaccccgacuccagcgagaucacgugcgugugccgcgacaacuggcacggguccaaccggcccugggugucguucaaccagaaccucgaguaccagaucggcuacaucugcuccgggaucuucggcgacaacccgcgccccaacgacaagaccgggagcugcggccccgucuccagcaacggcgccaacggggugaagggcuucagcuucaaguacgggaacggcguguggaucgggcggaccaaguccaucagcucccgcaagggcuucgagaugaucugggaccccaacggcuggaccgggaccgacaacaacuucucgaucaagcaggacaucgucggcaucaacgagugguccggguacagcggcuccuucgugcagcacccggagcugacggggcuggacugcauccggcccugcuucuggguggagcucauccgcggccggcccaaggagaacaccaucuggaccagcggcuccagcaucuccuucugcggggucaacagcgacaccgugggcugguccuggcccgacggggccgagcugccguucacgaucgacaaguga

SEQ ID NO: 27938 - RNA, 1410 nt, Artificial Sequence
  derived and/or modified CDS sequence (AUadapt) from InfluenzaA__AID70512__NA
augaaccccaaccagaagaucaucaccaucggcucgguguggaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaaggcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucaucgggaucaacgaguggucgggcuacuccgggagcuucguccagcacccggagcugacgggccuggacugcauccgccccugcuucuggguggagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 27939 - RNA, 1410 nt, Artificial Sequence; identical to SEQ ID NO: 22659
  derived and/or modified CDS sequence (AUadapt) from InfluenzaA__AID70514__NA

SEQ ID NO: 27940 - RNA, 1410 nt, Artificial Sequence
  derived and/or modified CDS sequence (AUadapt) from InfluenzaA__AID70515__NA
augaaccccaaccagaagaucaucaccaucggcucggugugcaugaccaucgggauggccaaccugauccuccagaucggcaacaucaucuccaucuggaucagccacuccauccagcugcgcaaccagagccagaucgagacgugcaaccaguccgucaucaccuacgagaacaacaccugggugaaccagaccuacgugaacaucagcaacacgaacuucgccgcggggcaguccgucgugagcgugaagcuggccggcaacuccucgcucugcccggucuccgggugggccaucuacagcaaggacaacuccauccggaucggcagcaagggcgacguguucgugauccgcgagcccuucaucuccugcagcccccuggagugccggaccuucuuccugacccagggggcccuccugaacgacaagcacuccaacggcaccaucaaggaccgcagccccuaccggacgcugauguccugcccgaucggggagguccccagccccuacaacucgcgcuucgaguccguggccuggagcgcguccgccugccacgacggcaucaacuggcucaccaucgggaucagcggccccgacaacggcgccguggccguccugaaguacaacgggaucaucaccgacaccaucaaguccuggcggaacaacauccugcgcacgcaggagagcgagugcgcgugcgugaacggcuccugcuucaccaucaugaccgacgggccgagcgacggccaggccuccuacaagaucuuccggaucgagaagggcaagaucgucaagagcguggagaugaacgcccccaacuaccacuacgaggagugcuccugcuaccccgacucguccgagaucacgugcgugugccgcgacaacuggcacgggagcaaccggcccuggguguccuucaaccagaaccucgaguaccagaucggcuacaucugcagcgggaucuucggcgacaacccgcgccccaacgacaagaccggguccugcggccccgucagcuccaacggcgccaacggggugaagggcuucagcuucaaguacagcaacgggguguggaucggccggaccaaguccaucucgucccgcaagggguucgagaugaucugggaccccaacggcuggaccggcaccgacaacaacuucagcaucaagcaggacaucgucgggaucaacgagugguccggcuacagcggguccuucgugcagcacccggagcugacgggccuggacugcauccggcccugcuucuggguggagcucauccgcgggcggcccaaggagaacaccaucuggaccagcggcuccagcaucuccuucugcggcgucaacagcgacaccguggggugguccuggcccgacggcgccgagcugccguucacgaucgacaaguga

SEQ ID NO: 27941 - RNA, 1410 nt, Artificial Sequence; identical to SEQ ID NO: 25560
  derived and/or modified CDS sequence (AUadapt) from InfluenzaA__AID70516__NA

SEQ ID NO: 27942 - RNA, 1410 nt, Artificial Sequence
  derived and/or modified CDS sequence (AUadapt) from InfluenzaA__AID70517__NA
augaaccccaaccagaagaucaucaccaucggcucggugugcaugaccaucgggauggccaaccugacgcuccagaucggcaacaucaucuccaucuggaucagccacuccauccagcuggggaaccagaaccagaucgagaccugcaaccagagcgucaucaccuacgagaacaacaccugggugaaccagacguacgugaacaucuccaacaccaacuucgccgcgggccagucggucguguccgugaagcuggccgggaacagcucccucugcccggucagcggcugggccaucuacuccaaggacaacagcauccgcaucggcuccaagggggacguguucgugauccgggagcccuucaucucgugcagcccccuggagugccgcaccuucuuccugacccagggcgcccuccugaacgacaagcacagcaacgggacgaucaaggaccggucccccuaccgcacccugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacacgaucaagucguggcgcaacaacauccugcggacccaggaguccgagugcgcgugcgugaacgggagcugcuucaccaucaugaccgacggcccgaacgacggccaggccuccuacaagaucuuccgcaucgagaaggggaagaucgugaaguccgucgagaugaacgcccccaacuaccacuacgaggagugcuccugcuaccccgacagcuccgagaucacgugcgugugccgggacaacuggcacggcucgaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaaguccaucucgagccggaagggcuucgagaugaucugggaccccaacggguggaccggcacggacaacaacuucuccaucaagcaggacaucgucgggaucaacgaguggagcggcuacuccgggucguucgugcagcacccggagcugaccggccuggacugcauccgccccugcuucuggguggagcucauccggggccgccccaaggagaacaccaucuggaccuccgggagcuccaucagcuucugcggcgucaacuccgacacggugggguggagcuggcccgacggcgccgagcugccguucaccaucgacaaguga

SEQ ID NO: 27943 - RNA, 1410 nt, Artificial Sequence
  derived and/or modified CDS sequence (AUadapt) from InfluenzaA__AID70518__NA
augaaccccaaccagaagaucaucaccaucggcucggugugcaugaccaucgggauggccaaccugauccuccagaucggcaacaucaucuccaucuggaucagccacuccauccagcugcgcaaccagagccagaucgagacgugcaaccaguccgucaucaccuacgagaacaacaccugggugaaccagaccuacgugaacaucagcaacacgaacuucgccgcggggcaguccgucgugucggugaagcuggccggcaacuccagccucugcccggucuccgggugggccaucuacagcaaggacaacuccauccggaucggcagcaagggcgacguguucgugauccgcgagcccuucaucuccugcagcccccuggagugccggaccuucuuccugacccagggggcccuccugaacgacaagcacuccaacggcaccaucaaggaccgcucgcccuaccggacgcugauguccugcccgaucggggagauccccagccccuacaacagccgcuucgaguccgucgccuggagcgcguccgccugccacgacggcaucaacuggcucaccaucgggaucagcggccccgacaacggcgccguggccgugcugaaguacaacgggaucaucaccgacaccaucaaguccuggcggaacaacauccugcgcacgcaggagucggagugcgcgugcgucaacggcuccugcuucaccaucaugaccgacgggccgagcgacggccaggccuccuacaagaucuuccggaucgagaagggcaagaucgucaagagcguggagaugaacgcccccaacuaccacuacgaggagugcuccugcuaccccgacagcuccgagaucacgugcgugugccgcgacaacuggcacgggagcaaccggcccuggguguccuucaaccagaaccucgaguaccagaucggcuacaucugcucggggaucuucggcgacaacccgcgccccaacgacaagaccggguccugcggccccgugagcuccaacggcgccaacggggucaagggcuucagcuucaaguacgggaacggcguguggaucgggcggaccaagagcaucuccagccgcaagggcuucgagaugaucugggaccccaacggcuggaccgggaccgacaacaacuucuccaucaagcaggacaucgugggcaucaacgaguggucgggguacuccggcagcuucguccagcacccggagcugacggggcuggacugcauccggcccugcuucuggguggagcucauccgcggccggcccaaggagaacaccaucuggaccuccggcagcuccaucagcuucugcggggugaacuccgacaccgucggcuggagcuggcccgacggggccgagcugccguucacgaucgacaaguga

SEQ ID NO: 27944 - RNA, 1410 nt, Artificial Sequence
  derived and/or modified CDS sequence (AUadapt) from InfluenzaA__AID70519__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaaggcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggucgggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 27945 - RNA, 1410 nt, Artificial Sequence
  derived and/or modified CDS sequence (AUadapt) from InfluenzaA__AID70520__NA
augaaccccaaccagaagaucaucaccaucggcucggugugcaugaccaucgggauggccaaccugauccuccagaucggcaacaucaucuccaucuggaucagccacuccauccagcugcgcaaccagagccagaucgagacgugcaaccaguccgucaucaccuacgagaacaacaccugggugaaccagaccuacgugaacaucagcaacacgaacuucgccgcggggcaguccgucgugucggugaagcuggccggcaacuccagccucugcccggucuccgggugggccaucuacagcaaggacaacuccauccggaucggcagcaagggcgacguguucgugauccgcgagcccuucaucuccugcagcccccuggagugccggaccuucuuccugacccagggggcccuccugaacgacaagcacuccaacggcaccaucaaggaccgcucgcccuaccggacgcugauguccugcccgaucggggagguccccagccccuacaacagccgcuucgaguccguggccuggagcgcguccgccugccacgacggcaucaacuggcucaccaucgggaucagcggccccgacaacggcgccguggccguccugaaguacaacgggaucaucaccgacaccaucaaguccuggcggaacaacauccugcgcacgcaggagucggagugcgcgugcgugaacggcuccugcuucaccaucaugaccgacgggccgagcgacggccaggccuccuacaagaucuuccggaucgagaagggcaagaucgucaagagcguggagaugaacgcccccaacuaccacuacgaggagugcuccugcuaccccgacagcuccgagaucacgugcgugugccgcgacaacuggcacgggagcaaccggcccuggguguccuucaaccagaaccucgaguaccagaucggcuacaucugcucggggaucuucggcgacaacccgcgccccaacgacaagaccggguccugcggccccgucagcuccaacggcgccaacggggugaagggcuucagcuucaaguacgggaacggcguguggaucgggcggaccaagagcaucuccagccgcaagggcuucgagaugaucugggaccccaacggcuggaccgggaccgacaacaacuucuccaucaagcaggacaucgucggcaucaacgaguggucgggguacuccggcagcuucgugcagcacccggagcugacggggcuggacugcauccggcccugcuucuggguggagcucauccgcggccggcccaaggagaacaccaucuggaccuccggcagcuccaucagcuucugcggggucaacuccggcaccgugggguggagcuggcccgacggcgccgagcugccguucacgaucgacaaguga

SEQ ID NO: 27946 - RNA, 1410 nt, Artificial Sequence
  derived and/or modified CDS sequence (AUadapt) from InfluenzaA__AID70521__NA
augaaccccaaccagaagaucaucaccaucggcucggugucccugaccaucagccgcaucugcuucuucaugcagaucgccauccucaucaacacggucacccugcacuucaagcaguacgaguucaacuccccgcccaacaaccaggugaugcugugcgagcccaccaucaucgagcggaacaucaccaagaucguguaccucacgaacaccaccaucgagaaggagaucugccccaagcuggccgaguaccgcucgugguccaagccgcagugcgacaucaccggguucgcgcccuucagcaaggacaacuccauccggcugagcgccggcggggacaucugggucacgcgcgagcccuacguguccugcgaccccgacaagugcuuccaguucgcccucggccaggggaccacccugaacaacgugcacucgaacgacaccguccacgaccggacgccguaccgcacccugcucaugaacgagcugggcgugcccuuccaccugggcaccaagcaggucugcaucgccugguccagcuccucgugccacgacgggaaggccuggcuccacgugugcaucaccggcgacgacaagaacgcgacggccuccaucaucuacaacgggcggcugguggacagcaucguguccuggagcaagaagauccugcgcacccaggaguccgagugcgucugcaucaacgggaccugcaccguggugaugacggacgggucggccagcggcaaggccgacaccaagauccucuucaucgaggagggcaagaucguccacaccuccacccugucgggguccgcgcagcacguggaggagugcagcugcuacccccgguaccccggcgugcgcugcgucugccgggacaacuggaagggguccaaccgcccgaucguggacaucaacaucaaggacuacagcaucguguccucguacgucugcuccggcuucgugggcgacacgccccggaagcccgaccgcagcuccucgucccacugccuggaccccaacaacgaggagggcggccacggggugaagggcugggccuucgacgacgggaacgacgucuggaugggccggaccaucagcgagaagucccgccucggcuacgagaccuucaaggugaucgggggcuggagcaacccgaacuccaagucgcagaucaaccggcaggucaucguggaccgcgggaaccgguccggcuacagcgggaucuucucgguggagggcaaguccugcaucaaccgcugcuucuacgucgagcugauccggggccgcaaggacgagaccgaggugcuguggacgagcaacuccaucguggucuucugcgggaccagcggcaccuacgggaccggcuccuggcccgacggggccgacaucaaccucaugcccaucuga

SEQ ID NO: 27947 - RNA, 1410 nt, Artificial Sequence
  derived and/or modified CDS sequence (AUadapt) from InfluenzaA__AID70522__NA
augaaccccaaccagaagaucaucaccaucggcucggugucccugaccaucagcacgaucugcuucuucaugcagaucgccauccucaucaccaccgucacccugcacuuccgccaguacgaguucaacuccccgcccaacaaccaggugaugcugugcgagcccacgaucaucgagcggaacaucaccgagaucguguaccucaccaacaccacgaucgagaaggagaucugccccaagcuggccgaguaccgcaacuggucgaagccgcagugcgacaucaccggguucgcgcccuucuccaaggacaacagcauccggcuguccgccggcggggacaucugggucacccgcgagcccuacgugucgugcgaccccgacaagugcuaccaguucgcccucggccaggggaccacgcugaacaacgugcacuccaacaacaccguccgggaccgcaccccguaccggacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcgccugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcugcagaucaaccgccaggugaucguggaccggggcaaccgguccggguacucgggcaucuucuccgucgagggcaagagcugcaucaaccgcugcuucuacguggagcucauccgggggcgcaaggaggagaccgaggugcuguggaccucgaacuccaucgucguguucugcggcacgagcgggaccuacggcaccggguccuggccggacggcgccgaccugaaccucaugcccaucuga

SEQ ID NO: 27948 - RNA, 1410 nt, Artificial Sequence
  derived and/or modified CDS sequence (AUadapt) from InfluenzaA__AID70523__NA
augaaccccaaccagaagaucaagaccaucggcucggugucccugaccaacucgacgaucugcaucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccucgucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaguucaucguggaccggggcaaccgcuccggguacucgggcaucuucuccguggagggcaagagcugcaucaaccggugcuucuacgucgagcucauccgcgggcggaaggaggagaccgaggugcuguggaccucgaacuccaucguggucuucugcggcacgagcgggaccuacggcaccggguccuggccggacggcgccgaccugaaccucaugcccaucuga

SEQ ID NO: 27949 - RNA, 1410 nt, Artificial Sequence
  derived and/or modified CDS sequence (AUadapt) from InfluenzaA__AID70524__NA
augaaccccaaccagaagaucaucaccaucggcgccguguggcgcaccaucucgacgaucugcuucuucaugcagaucgccuuccugaucaccaccgucacccuccacuucaagcaguacgaguucaacuccccgcccaacaaccaggugaugcccugcgagcccacgaucaucgagcggaacaucaccgagaucguguaccugaccaacaccacgaucgagaaggagaucugcccgaagcuggcggaguaccgcaacuggucgaagccccagugcgacaucaccggguucgcccccuucuccaaggacaacagcauccggcucuccgccggcggggacaucugggucacccgcgagcccuacgugucgugcgacccggacaagugcuaccaguucgcccugggccaggggaccacgcugaacaacgugcacuccaacaacaccguccgggaccgcacccccuaccggacccuccugaugaacgagcugggcgugcccuuccaccucggcacgaagcaggucugcaucgccuggagcuccucguccugccacgacgggaaggcguggcugcacgugugcaucaccggcgacgacaagaacgccaccgccagcuucaucuacaacgggcgccugguggacuccguggucucgugguccaaggagauccuccggacccaggagucggagugcgugugcaucaacggcacgugcaccguggucaugaccgacggguccgccagcggcaaggcggacaccaagauccuguucaucgaggagggcaagaucgugcacacguccacccugucggggagcgcccagcacguggaggagugcuccugcuacccccgcuacccgggcguccggugcgugugccgcgacaacuggaaggggucgaaccggcccaucguggacaucaacaucaaggaccacuccaucgucagcuccuacgugugcucgggccucgugggcgacaccccgcgcaagaacgacuccucguccagcucccacugccuggaccccaacaacgaggagggcgggcacggggucaagggcugggccuucgacgacgggaacgacguguggaugggccggaccaucaacgagacgucgcgccugggcuacgagaccuucaaggucaucgaggggugguccaaccccaagagcaagcuccagaucaaccgccaggugaucguggaccggggcaaccgguccggguacucgggcaucuucuccgucgagggcaagagcugcaucaaccgcugcuucuacguggagcugauccgggggcgcaaggaggagaccgaggugcuguggaccuccaacucgaucgucguguucugcggcacgagcgggaccuacggcaccggguccuggcccgacggcgccgaccucaaccugaugcccaucuga

SEQ ID NO: 27950 - RNA, 1410 nt, Artificial Sequence
  derived and/or modified CDS sequence (AUadapt) from InfluenzaA__AID70525__NA
augaaccccaaccagaagaucaucaccaucggcucggugucccugaccaucuggaucaucugcuucuucaugcagaucgccauccucaucacgaccgucacccugcacuucaagcaguacgaguucaacagcccgcccaacaaccaggugaugcugugcgagcccaccaucaucgagcgcaacaucacggagaucguguaccucaccaacaccaccaucgagaaggagaucugccccaagcuggccgaguaccggaacugguccaagccgcagugcgacaucacgggguucgcgcccuucucgaaggacaacuccauccgccugagcgccggcggggacaucugggucacccgggagcccuacguguccugcgaccccgacaagugcuaccaguucgcccucggccaggggaccacccugaacaacgugcacucgaacaacacgguccgcgaccggaccccguaccgcacccugcucaugaacgagcugggcgugcccuuccaccugggcaccaagcaggucugcaucgccugguccagcuccucgugccacgacgggaaggccuggcuccacgugugcaucacgggcgacgacaagaacgcgaccgccuccuucaucuacaacgggcggcugguggacagcguggucuccuggucgaaggagauccugcgcacccaggaguccgagugcgugugcaucaacgggaccugcacgguggucaugaccgacgggagcgccuccggcaaggccgacaccaagauccucuucaucgaggagggcaagaucgugcacaccucgacgcugagcggguccgcgcagcacguggaggagugcagcugcuacccccgguaccccggcguccgcugcgugugccgggacaacuggaagggguccaaccgcccgaucguggacaucaacaucaaggaccacucgaucgucuccagcuacgugugcuccggccuggugggcgacacgccccggaagaacgacucguccagcuccucgcacugccucgaccccaacaacgaggagggcggccacggggucaagggcugggccuucgacgacgggaacgacguguggaugggccgcaccaucaacgagaccucccggcugggcuacgagaccuucaaggucaucgagggguggagcaaccccaaguccaagcugcagaucaaccgccaggugaucguggaccggggcaaccgcucgggguacuccggcaucuucagcgucgaggggaaguccugcaucaaccggugcuucuacguggagcucauccgcggccggaaggaggagaccgaggugcuguggaccucgaacagcaucgucguguucugcggcaccuccgggacguacggcaccgggagcuggccggacggcgccgaccugaacaucaugcccaucuga

SEQ ID NO: 27951 - RNA, 1410 nt, Artificial Sequence; identical to SEQ ID NO: 21920
  derived and/or modified CDS sequence (AUadapt) from InfluenzaA__AID70526__NA

SEQ ID NO: 27952 - RNA, 1410 nt, Artificial Sequence
  derived and/or modified CDS sequence (AUadapt) from InfluenzaA__AID70527__NA
augaaccccaaccagaagaucaucaccaucggcucggugucccugaccauguggaucaucugcuucuucaugcagaucgccauccucaucacgaccgucacccugcacuucaagcaguacgaguucaacagcccgcccaacaaccaggugaugcugugcgagcccaccaucaucgagcgcaacaucacggagaucguguaccucaccaacaccaccaucgagaaggagaucugccccaagcuggccgaguaccggaacugguccaagccgcagugcgacaucacgggguucgcgcccuucucgaaggacaacuccauccgccugagcgccggcggggacaucugggucacccgggagcccuacguguccugcgaccccgacaagugcuaccaguucgcccucggccaggggaccacccugaacaacgugcacucgaacaacacgguccgcgaccggaccccguaccgcacccugcucaugaacgagcugggcgugcccuuccaccugggcaccaagcaggucugcaucgccugguccagcuccucgugccacgacgggaaggccuggcuccacgugugcaucacgggcgacgacaagaacgcgaccgccuccuucaucuacaacgggcggcugguggacagcguggucuccuggucgaaggagauccugcgcacccaggaguccgagugcgugugcaucaacgggaccugcacgguggucaugaccgacgggagcgccuccggcaaggccgacaccaagauccucuucaucgaggagggcaagaucgugcacaccucgacgcugagcggguccgcgcagcacguggaggagugcagcugcuacccccgguaccccggcguccgcugcgugugccgggacaacuggaagggguccaaccgcccgaucguggacaucaacaucaaggaccacucgaucgucuccagcuacgugugcuccggccuggugggcgacacgccccggaagaacgacucguccagcuccucgcacugccucgaccccaacaacgaggagggcggccacggggucaagggcugggccuucgacgacgggaacgacguguggaugggccgcaccaucaacgagaccucccggcugggcuacgagaccuucaaggucaucgagggguggagcaaccccaaguccaagcugcagaucaaccgccaggugaucguggaccggggcaaccgcucgggguacuccggcaucuucagcgucgaggggaaguccugcaucaaccggugcuucuacguggagcucauccgcggccggaaggaggagaccgaggugcuguggaccucgaacagcaucgucguguucugcggcaccuccgggacguacggcaccgggagcuggccggacggcgccgaccugaaccucaugcccaucuga

SEQ ID NO: 27953 - RNA, 1410 nt, Artificial Sequence
  derived and/or modified CDS sequence (AUadapt) from InfluenzaA__AID70528__NA
augaaccccaaccagaagaucaucaccaucggcucggugucccugagcaucuccaccaucugcuucuucaugcagaucgccauccucaucacgaccgucacccugcacuucaagcaguacgaguucaacucgccgcccaacaaccaggugaugcugugcgagcccaccaucaucgagcgcaacaucacggagaucguguaccucaccaacaccaccaucgagaaggagaucugccccaagcuggccgaguaccggaacugguccaagccgcagugcgacaucacgggguucgcgcccuucagcaaggacaacuccauccgccugucggccggcggggacaucugggucacccgggagcccuacguguccugcgaccccgacaagugcuaccaguucgcccucggccaggggaccacccugaacaacgugcacagcaacaacacgguccgcgaccggaccccguaccgcacccugcucaugaacgagcugggcgugcccuuccaccugggcaccaagcaggucugcaucgccugguccucguccagcugccacgacgggaaggccuggcuccacgugugcaucacgggcgacgacaagaacgcgaccgccuccuucaucuacaacgggcggcugguggacucgguggucuccuggagcaaggagauccugcgcacccaggaguccgagugcgugugcaucaacgggaccugcacgguggucaugaccgacgggucggccagcggcaaggccgacaccaagauccucuucaucgaggagggcaagaucgugcacaccuccacgcugucgggguccgcgcagcacguggaggagugcagcugcuacccccgguaccccggcguccgcugcgugugccgggacaacuggaagggguccaaccgcccgaucguggacaucaacaucaaggaccacucgaucgucuccagcuacgugugcuccggccuggugggcgacacgccccggaagaacgacucguccagcuccucgcacugccucgaccccaacaacgaggagggcggccacggggucaagggcugggccuucgacgacgggaacgacguguggaugggccgcaccaucaacgagaccucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgaccugaaccucaugcccaucuga

SEQ ID NO: 27954 - RNA, 1410 nt, Artificial Sequence; identical to SEQ ID NO: 21920
  derived and/or modified CDS sequence (AUadapt) from InfluenzaA__AID70529__NA

SEQ ID NO: 27955 - RNA, 1410 nt, Artificial Sequence
  derived and/or modified CDS sequence (AUadapt) from InfluenzaA__AID70530__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggaccggggcaaccgcuccggguacucgggcaucuucuccgucgagggcaagagcugcaucaaccggugcuucuacguggagcucauccgcgggcggaaggaggagaccgaggugcuguggaccucgaacuccaucgucguguucugcggcacgagcgggaccuacggcaccggguccuggccggacggcgccgaccugaacaucaugcccaucuga

SEQ ID NO: 27956 - RNA, 1410 nt, Artificial Sequence; identical to SEQ ID NO: 21920
  derived and/or modified CDS sequence (AUadapt) from InfluenzaA__AID70531__NA

SEQ ID NO: 27957 - RNA, 1410 nt, Artificial Sequence
  derived and/or modified CDS sequence (AUadapt) from InfluenzaA__AID70532__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccucgucccacugccucgaccccaacaacgaggagggcgggcacggggucaagggcugggccuucgacgacgggaacgacguguggaugggccgcaccaucaacgagaccagccggcugggcuacgagacccugaaggucaucgaggggugguccaaccccaagucgaagcuccagaucaaccgccaggugaucguggaccggggcaaccgcuccggguacuacggcaucuucagcgucgaggggaaguccugcaucaaccggugcuucuacguggagcugaucuggggccgcaaggaggagaucgaggugcuguggaccucgaacagcaaggucguguucugcggcaccuccgggacguacggcaccgggagcuccccggacggcgccgaccucaacuucaugcccaucuga

SEQ ID NO: 27958 - RNA, 1410 nt, Artificial Sequence
  derived and/or modified CDS sequence (AUadapt) from InfluenzaA__AID70533__NA
augaaccccaaccagaagaucaucaccaucggcucggugucccuggccaucagcaccaucugcuucuucaugcagaucgccauccucaucacgaccgucacccugcacuucaagcaguacgaguucaacuccccgcccaacaaccaggugaugcugugcgagcccaccaucaucgagcgcaacaucacggagaucguguaccucaccaacaccaccaucgagaaggagaucugccccaagcuggcggaguaccggaacuggucgaagccgcagugcgacaucacgggguucgcccccuucuccaaggacaacagcauccgccuguccgccggcggggacaucugggucacccgggagcccuacgugucgugcgaccccgacaagugcuaccaguucgcccucggccaggggaccacccugaacaacgugcacuccaacaacacgguccgcgaccggaccccguaccgcacccugcucaugaacgagcugggcgugcccuuccaccugggcaccaagcaggucugcaucgccuggagcuccucguccugccacgacgggaaggcguggcuccacgugugcaucacgggcgacgacaagaacgccaccgccagcuucaucuacaacgggcggcugguggacuccguggucucgugguccaaggagauccugcgcacccaggagagcgagugcgugugcaucaacgggaccugcacgguggucaugaccgacggguccgccucgggcaaggcggacaccaagauccucuucaucgaggagggcaagaucgugcacaccagcacgcuguccgggucggcccagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcggccacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggaccggggcaaccgcuccggguacucgggcaucuucuccgucgagggcaagagcugcaucaaccggugcuucuacguggagcucauccgcgggcggaaggaggagaccgaggugcuguggaccucgaacuccaucgucguguucugcggcaccagcgggacguacggcaccggguccuggccggacggcgccgaccugaaccucaugcccaucuga

SEQ ID NO: 27959 - RNA, 1410 nt, Artificial Sequence
  derived and/or modified CDS sequence (AUadapt) from InfluenzaA__AID70534__NA
augaaccccaaccagaagaucaucaccaucggcucggugucccugagcaucuacaucaucugcuucuucaugcagaucgccauccucaucaccacggucacccugcacuucaagcaguacgaguucaacuccccgcccaacaaccaggccaugcccugcgagcccaccaucaucgagcgcaacaucaccgagaucguguaccugacgaacaccaccaucgagaaggagaucugcccgaagcucgcggaguaccggaacuggucgaagccccagugcgacaucaccggguucgcccccuucuccaaggacaacagcauccgccuguccgccggcggggacaucugggugacgcgggagcccuacgucucgugcgacccggacaagugcuaccaguucgcccugggccaggggaccacccucaacaacgugcacuccaacaacaccgugcgcgaccggacgcccuaccgcacccugcugaugaacgagcucggcguccccuuccaccugggcaccaagcaggucugcaucgccuggagcuccucguccugccacgacgggaaggcguggcugcacgugugcaucaccggcgacgacaagaacgccacggccagcuucaucuacaacgggcggcucguggacuccguggugucgugguccaaggagauccugcgcacccaggagagcgagugcgucugcaucaacgggaccugcaccguggugaugacggacggguccgccucgggcaaggcggacaccaagauccuguucaucgaggagggcaagaucguccacaccagcacccucuccgggucggcccagcacguggaggagugcuccugcuacccccgguacccgggcgugcgcugcgucugccgggacaacuggaaggggagcaaccgccccaucguggacaucaacaucaaggaccacuccaucgugucguccuacgucugcagcggccuggugggcgacacgccccggaagaacgacuccucguccagcucccacugccuggaccccaacaacgaggagggcggccacggggugaagggcugggccuucgacgacgggaacgacgucuggaugggccgcaccaucaacgagaccucgcggcucggcuacgagaccuucaaggugaucgaggggugguccaaccccaagagcaagcugcagaucaaccgccaggucaucguggaccggggcaaccgcuccggguacucgggcaucuucuccguggagggcaagagcugcaucaaccggugcuucuacgucgagcugauccgcgggcggaaggaggagacggaggugcucuggaccucgaacuccaucguggucuucugcggcaccagcgggaccuacggcacgggguccuggccggacggcgccgaccugaaccugaugcccaucuga

SEQ ID NO: 27960 - RNA, 1410 nt, Artificial Sequence
  derived and/or modified CDS sequence (AUadapt) from InfluenzaA__AID70535__NA
augaaccccaaccagaagaucaucaccaucggcucggugucccuggccaugugcaccaucugcuucuucaugcagaucgccauccucaucacgaccgucacccugcacuucaagcaguacgaguucaacucgccgcccaacaaccaggcgaugcccugcgagcccaccaucaucgagcgcaacaucacggagaucguguaccugaccaacaccaccaucgagaaggagaucugcccgaagcucgccgaguaccggaacugguccaagccccagugcgacaucacgggguucgcccccuucagcaaggacaacuccauccgccugucggccggcggggacaucugggugacccgggagcccuacgucuccugcgacccggacaagugcuaccaguucgcccugggccaggggaccacccucaacaacgugcacagcaacaacacggugcgcgaccggacccccuaccgcacccugcugaugaacgagcucggcguccccuuccaccugggcaccaagcaggucugcaucgcgugguccucguccucgugccacgacgggaaggccuggcugcacgugugcaucacgggcgacgacaagaacgccaccgccuccuucaucuacaacgggcggcucguggacagcgugguguccuggucgaaggagauccugcgcacccaggaguccgagugcgucugcaucaacgggaccugcacgguggugaugaccgacgggagcgcguccggcaaggccgacaccaagauccuguucaucgaggagggcaagaucguccacaccucgacgcucagcggguccgcccagcacguggaggagugcucgugcuacccccgguacccgggcgugcgcugcgucugccgggacaacuggaagggguccaaccgccccaucguggacaucaacaucaaggaccacucgaucguguccagcuacgucugcuccggccuggugggcgacacgccccggaagaacgacucguccagcuccucgcacugccuggaccccaacaacgaggagggcggccacggggugaagggcugggccuucgacgacgggaacgacgucuggaugggccgcaccaucaacgagaccucccggcucggcuacgagaccuucaaggugaucgagggguggucgaacccgaaguccaagcugcagaucaaccgccaggucaucguggaccggggcaaccgcagcggguacuccggcaucuucucgguggaggggaaguccugcaucaaccggugcuucuacgucgagcugauccgcggccggaaggaggagaccgaggugcucuggaccagcaacucgaucguggucuucugcggcaccuccgggacguacggcaccgggagcuggcccgacggcgccgaccugaaccugaugcccaucuga

SEQ ID NO: 27961 - RNA, 1410 nt, Artificial Sequence
  derived and/or modified CDS sequence (AUadapt) from InfluenzaA__AID70536__NA
augaaccccaaccagaagaucaucaccaucggcucggugucccugaccaucagcacggucugcuucuucaugcagaucgccauccucaucaccaccgugacccugcacuucaagcaguacgaguucaacuccccgcccaacaaccaggugaugcugugcgagcccacgaucaucgaccgcaacaucaccgagaucgucuaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccgucgugucgugguccaaggagauccugcgcacccaggagagcgagugcgugugcaucaacggcacgugcaccgucgugaugaccgacggguccgccucgggcaaggccgacaccaagauccucuucaucgaggagggcaagaucgugcacacgagcacccuguccgggucggcgcagcacgucgaggagugcuccugcuacccccgguaccccggcgugcgcugcgugugccgggacaacuggaaggggagcaaccgcccgaucgucgacaucaacaucaaggaccacuccaucgugucguccuacgugugcagcggccuggucggcgacacgccccggaagaacgacuccucguccagcucccacugccucgaccccaacaacgaggagggcgggcacggggugaagggcugggccuucgacgacgggaacgacgucuggaugggccgcaccaucaacgagaccucgcggcugggcuacgagaccuucaaggugaucgaggggugguccaaccccaagagcaagcugcagaucaaccgccaggugaucgucgaccggggcaaccgcuccggguacucgggcaucuucuccguggagggcaagagcugcaucaaccggugcuucuacguggagcucauccgcgggcggaaggaggagaccgagguccuguggaccucgaacuccaucgugguguucugcggcacgagcgggaccuacggcaccggguccuggccggacggcgccgaccugaaccucaugcccaucuga

SEQ ID NO: 27962 - RNA, 1410 nt, Artificial Sequence; identical to SEQ ID NO: 21920
  derived and/or modified CDS sequence (AUadapt) from InfluenzaA__AID70537__NA

SEQ ID NO: 27963 - RNA, 1410 nt, Artificial Sequence
  derived and/or modified CDS sequence (AUadapt) from InfluenzaA__AID70538__NA
augaaccccaaccagaagaagaucaccaucggcgccgugucgcugaccaugugcacggucugcaucuucaugcagaucgccauccucaucaccaccgugacccugcacuuccgccaguacgaguucaacuccccgcccaacaaccaggugaugcugugcgagcccacgaucaucgagcggaacaucaccgagaucgucuaccucaccaacaccacgaucgagaaggagaucugccccaagcuggcggaguaccgcaacuggucgaagccgcagugcgacaucaccggguucgcccccuucuccaaggacaacagcauccggcuguccgccggcggggacaucugggugacccgcgagcccuacgugucgugcgaccccgacaagugcuaccaguucgcccucggccaggggaccacgcugaacaacguccacuccaacaacaccgugcgggaccgcaccccguaccggacccugcucaugaacgagcugggcgugcccuuccaccugggcacgaagcaggucugcaucgccuggucguccagcuccugccacgacgggaaggcguggcuccacgugugcaucaccggcgacgacaagaacgccaccgccucguucaucuacaacgggcgccugguggacuccgucgugagcugguccaaggagauccugcggacccaggagucggagugcgugugcaucaacggcacgugcaccgucgugaugaccgacggguccgccucgggcaaggcggacaccaagauccucuucaucgaggagggcaagaucgugcacacguccacccugagcgggucggcccagcacgucgaggagugcuccugcuacccccgcuaccccggcgugcggugcgugugccgcgacaacuggaaggggagcaaccggccgaucgucgacaucaacaucaaggaccacuccaucgugucguccuacgugugcucgggccuggucggcgacacgccccgcaagaacgacuccagcuccucgucccacugccucgaccccaacaacgaggagggcgggcacggggugaagggcugggccuucgacgacgggaacgacgucuggaugggccggaccaucaacgagaccagccgccugggcuacgagaccuucaaggugaucgaggggugguccaaccccaagucgaagcugcagaucaaccgccaggugaucgucgaccggggcaaccgguccggguacucgggcaucuucuccguggagggcaagagcugcaucaaccgcugcuucuacguggagcucauccgggggcgcaaggaggagaccgagguccuguggaccuccaacucgaucgugguguucugcggcacgagcgggaccuacggcaccggguccuggccggacggcgccgaccugaaccucaugcccaucuga

SEQ ID NO: 27964 - RNA, 1410 nt, Artificial Sequence
  derived and/or modified CDS sequence (AUadapt) from InfluenzaA__AID70539__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucaaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggaccggggcaaccgcuccggguacucgggcaucuucuccgucgagggcaagagcugcaucaaccggugcuucuacguggagcucauccgcgggcggaaggaggagaccgaggugcuguggaccucgaacuccaucgucguguucugcggcacgagcgggaccuacggcaccggguccuggccggacggcgccgaccugaaccucaugcccaucuga

SEQ ID NO: 27965 - RNA, 1410 nt, Artificial Sequence; identical to SEQ ID NO: 21920
  derived and/or modified CDS sequence (AUadapt) from InfluenzaA__AID70540__NA

SEQ ID NO: 27966 - RNA, 1410 nt, Artificial Sequence; identical to SEQ ID NO: 21920
  derived and/or modified CDS sequence (AUadapt) from InfluenzaA__AID70541__NA

SEQ ID NO: 27967 - RNA, 1410 nt, Artificial Sequence
  derived and/or modified CDS sequence (AUadapt) from InfluenzaA__AID70633__NA
augaaccccaaccagaagaucaucaccaucggcucggugugcaugaccaucgggauggccaaccugauccuccagaucggcaacaucaucuccaucugggucagccacuccauccagcuggggaaccagagccagaucgaggccugcaaccaguccgugaucacguacgagaacaacaccugggugaaccagaccuacgucaacaucagcaacaccaacuucgcggccggccaguccguggugagcgucaagcuggccgggaacuccucgcucugcccgguguccggcugggccaucuacagcaaggacaacuccgugcgcaucggcagcaagggggacgucuucgugauccgggagcccuucaucuccugcagcccccuggagugccgcacguucuuccugacccagggcgcccuccugaacgacaagcacuccaacgggaccaucaaggaccggagccccuaccgcacccugauguccugcccgaucggcgaggugcccagccccuacaacucgcgguucgaguccgucgcguggagcgccuccgccugccacgacgggaucaacuggcucacgaucggcaucagcggccccgacuccggggccguggcggugcugaaguacaacggcaucaucaccgacaccaucaagagcuggcgcaacaacauccugcggacccaggaguccgagugcgccugcgucaacgggagcugcuucacgaucaugaccgacggcccguccgacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcguguucggggacaacccgcggcccaacgacaagaccggcagcugcggccccgucuccagcaacggggccaacggcgugaagggguucagcuucaaguacggcaacgggguguggaucggccgcaccaaguccaucucgucccggaagggcuucgagaugaucugggaccccaacggguggaccggcaccgacaacaaguucagcaucaagcaggacaucgucgggaucaacgagugguccggcuacagcggguccuucgugcagcacccggagcugaccggccuggacugcauccgccccugcuucugggucgagcucauccggggccgccccgaggagaacacgaucuggaccagcggguccagcaucuccuucugcggcgugaacagcgacaccguggggugguccuggcccgacggcgcggagcugccguucaccaucgacaaguga

SEQ ID NO: 27968 - RNA, 1398 nt, Artificial Sequence
  derived and/or modified CDS sequence (AUadapt) from InfluenzaA__AID70635__NA
augaaucccaagcagaagauccugugcaccucggccaccgccaucaucaucggcgcgaucgccgugcucaucgggaucgccaaccugggccugaacaucgggcuccaccugaagccgggcugcaacugcucccacucgcagcccgagacgaccaacaccucccagaccaucaucaacaacuacuauaacgagacgaacaucaccaacauccagauggaggagcgcaccucgcggaacuucaacaaccugaccaaggggcucugcacgaucaacuccuggcacaucuacggcaaggacaacgccguccgcaucggcgagucguccgaugugcuggugacccgggagcccuacgucucgugcgaccccgacgagugccgcuucuacgcccugucccaggggaccaccauccggggcaagcacucgaacgggacgauccacgacggcucccaguaccgcgcgcucaucucguggccgcuguccaguccgcccaccguguacaacucccggguggagugcaucggguggucguccaccucgugccacgacggcaagucccgcaugucgaucugcaucucgggccccaacaacaacgccuccgccgucgugugguacaaucggcgccccguggccgagaucaacaccugggcgcggaacauccugcgcacgcaggagucggagugcgucugccacaacggggugugccccguggucuucaccgacggcuccgccaccgggcccgccgacacccggaucuacuacuucaaggagggcaagauccucaagugggagagucugacgggcaccgccaagcacaucgaggagugcuccugcuacggggagcgcaccggcaucacgugcacgugccgggacaacuggcaggggucgaaccgccccgugauccagaucgacccgguggccaugacccacaccucccaguacaucugcucgcccguccugaccgauaacccccggcccaacgacccgaacaucggcaagugcaacgaccccuaccccgggaacaacaacaacggcgugaagggcuucuccuaccucgacggggcgaauaccuggcugggccgcaccaucucgaccgccucccggucgggguacgagaugcugaaggugcccaacgcccucaccgacgaccgcuccaagccgauccagggccagacgaucguccugaacgccgacuggucgggguacuccggcucguucauggacuacugggccgagggcgacuguuaccgggcgugcuucuacguggagcugauccgcgggcgccccaaggaggacaaggugugguggaccuccaacucgaucgucuccaugugcucgucgaccgaguuccucggccaguggaacuggcccgacggggccaagaucgaguacuuccuguga

SEQ ID NO: 27969 - RNA, 1401 nt, Artificial Sequence
  derived and/or modified CDS sequence (AUadapt) from InfluenzaA__AIG44695__NA
augaaccccaaccagaagaucaccgccaucggcucggugucccugaucaucgccaucaucugccuccugaugcagaucgcgauccugaccacgaccaugacccuccacuuccgccagaacgagugcucgaacccguccaacaaccaggucaugcccugcgagcccaucaucaucgagcggaacaccgugcaccugaacagcacgaccaucgagcgcgagaucugccccaagguggccgaguacaagaacugguccaagccgcagugccagaucaccggguucgcccccuucucgaaggacaacuccauccggcugucggccuccggcgacaucugggucacccgcgagcccuacgugagcugcucccucgacaagugcuaccaguucgcccuggggcagggcacgacccugaagaacaagcacucgaacgggaccacccacgaccggacgccccaccgcacccuccugaugaacgagcugggcgugccguuccaccucggcaccaagcaggucugcaucgcgugguccucguccagcugcuacgacgggaaggccuggcugcacgugugcgugaccggcgacgacaagaacgccacggccuccaucaucuacgacgggaugcuggucgacucggugggcuccuggucgaagaacauccuccggacccaggagagcgagugcgugugcaucaacgggaccugcgcggucgugaugaccgacggcuccgccucgggcaaggccgacacgcgcgugcuguucauccgggaggggaagaucaucaacaucucgccccuguccggcuccgcccagcacgucgaggagugcagcugcuacccccgcuaccccgaggugcggugcgugugccgcgacaacuggaagggguccaaccggccgauccucuacaucaacauggccgacuacucgaucgaguccucguacgucugcuccggccuggugggcgacacgccccgcaacgacgacagcuccucguccucgaacugccgggaccccaacaacgagcgcggggcgcccggcgugaaggggugggccuucgacgacggcaacgacgucuggauggggcggaccaucaagaacggcucccgcagcggcuacgagaccuuccggguggugaacggguggaccauggccaacuccaagucgcagaucaaccgccaggucaucguggacucggacggcugguccggguacagcggcaucuucuccgucgaggggaagaagugcaucaaccggugcuucuacguggagcugauccgcggccgcccgcaggagccccgggugugguggaccucgaacuccaucaucgucuucugcggcaccagcgggaccuacggcacgggguccuggcccgacggcgccaacaucaacuucaugcccaucuga

SEQ ID NO: 27970 - RNA, 1410 nt, Artificial Sequence
  derived and/or modified CDS sequence (AUadapt) from InfluenzaA__AIJ10793__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccucgucccacugccucgaccccaacaacgaggagggcgggcacggggucaagggcugggccuucgacgacgggaacgacguguggaugggccgcaccaucaacgagaccucgcggcugggcuacgagaccuucaaggccaucgaggggugguccaaccccaagagcaagcugcagaccaaccgccaggucaucguggaccggggcaaccgcuccggguacucgggcaucuucuccguggagggcaagagcugcaucaaccggugcuucuacgucgagcucauccgcgggcggaaggaggagaccgaggugcuguggacgucgaacuccaucguggucuucugcggcaccagcgggaccuacggcaccggguccuggccggacggcgccgaccugaaccucaugcccaucuga

SEQ ID NO: 27971 - RNA, 1410 nt, Artificial Sequence; identical to SEQ ID NO: 21920
  derived and/or modified CDS sequence (AUadapt) from InfluenzaA__AIJ10794__NA

SEQ ID NO: 27972 - RNA, 1410 nt, Artificial Sequence; identical to SEQ ID NO: 23545
  derived and/or modified CDS sequence (AUadapt) from InfluenzaA__AIJ10795__NA

SEQ ID NO: 27973 - RNA, 1410 nt, Artificial Sequence; identical to SEQ ID NO: 23545
  derived and/or modified CDS sequence (AUadapt) from InfluenzaA__AIJ10796__NA

SEQ ID NO: 27974 - RNA, 1410 nt, Artificial Sequence
  derived and/or modified CDS sequence (AUadapt) from InfluenzaA__AIJ10797__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcugcagaucaaccgccaggugaucguggaccggggcaaccgguccggguacucgggcaucuucuccgucgaggacaagagcugcaucaaccgcugcuucuacguggagcucauccgggggcgcaaggaggagaccgaggugcuguggaccucgaacuccaucgucguguucugcggcacgagcggcaccuacgggaccggcuccuggccggacggggccgaccugaaccucaugcccaucuga

SEQ ID NO: 27975 - RNA, 1410 nt, Artificial Sequence
  derived and/or modified CDS sequence (AUadapt) from InfluenzaA__AIJ10798__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccacccuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacgcaggagagcgagugcgugugcaucaacgggaccugcaccguggucaugaccgacggguccgccucgggcaaggccgacacgaagauccucuucaucgaggagggcaagaucgugcacaccagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcggccacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggaccggggcaaccgcuccggguacucgggcaucuucuccgucgagggcaagagcugcaucaaccggugcuucuacguggagcucauccgcgggcggaaggaggagaccgaggugcuguggacgucgaacuccaucgucguguucugcggcaccagcgggaccuacggcaccggguccuggccggacggcgccgaccugaaccucaugcccaucuga

SEQ ID NO: 27976 - RNA, 1410 nt, Artificial Sequence; identical to SEQ ID NO: 23545
  derived and/or modified CDS sequence (AUadapt) from InfluenzaA__AIJ10799__NA

SEQ ID NO: 27977 - RNA, 1410 nt, Artificial Sequence
  derived and/or modified CDS sequence (AUadapt) from InfluenzaA__AIJ10800__NA
augaaccccaaccagaagaucaucaccaucggcucggugucccugaccaucagcacgaucugcuucuucaugcagaucgccauccucaucaccaccgucacccugcacuucaagcaguacgaguucaacuccucgccgaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgccguucagcaaggacaacuccauccgccugucggccggcggggacaucugggucacccgggagcccuacguguccugcgaccccgacaagugcuaccaguucgcccucggccaggggaccacgcugaacaacgugcacagcaacaacaccguccgcgaccggacccccuaccgcacccugcucaugaacgagcugggcgugccguuccaccugggcacgaagcaggucugcaucgccugguccucguccagcugccacgacgggaaggccuggcuccacgugugcaucaccggcgacgacaagaacgcgaccgccuccuucaucuacaacgggaagcugguggacucgguggucuccuggagcaaggagauccugcggacccaggaguccgagugcgugugcaucaacggcacgugcaccguggucaugaccgacgggucggccagcggcaaggccgacaccaagauccucuucaucgaggagggcaagaucgugcacacguccacccugucgggguccgcgcagcacguggaggagugcagcugcuacccccgcuaccccggcguccggugcgugugccgcgacaacuggaagggguccaaccggcccaucguggacaucaacaucaaggaccacucgaucgucuccagcuacgugugcuccggccuggugggcgacaccccgcgcaagaacgacucguccagcuccucgcacugccucgaccccaacaacgaggagggcgggcacggggucaagggcugggccuucgacgacgggaacgacguguggaugggccggaccaucaacgagacgucccgccugggcuacgagaccuucaaggucaucgagggguggagcaaccccaaguccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcacguccgggaccuacggcaccgggagcuggcccgacggcgccgaccugaaccucaugccgaucuga

SEQ ID NO: 27978 - RNA, 1410 nt, Artificial Sequence; identical to SEQ ID NO: 16339
  derived and/or modified CDS sequence (AUadapt) from InfluenzaA__AIJ10801__NA

SEQ ID NO: 27979 - RNA, 1410 nt, Artificial Sequence; identical to SEQ ID NO: 16339
  derived and/or modified CDS sequence (AUadapt) from InfluenzaA__AIJ10803__NA

SEQ ID NO: 27980 - RNA, 1410 nt, Artificial Sequence; identical to SEQ ID NO: 16339
  derived and/or modified CDS sequence (AUadapt) from InfluenzaA__AIJ10804__NA

SEQ ID NO: 27981 - RNA, 1410 nt, Artificial Sequence; identical to SEQ ID NO: 16339
  derived and/or modified CDS sequence (AUadapt) from InfluenzaA__AIJ10805__NA

SEQ ID NO: 27982 - RNA, 1410 nt, Artificial Sequence
  derived and/or modified CDS sequence (AUadapt) from InfluenzaA__AIJ10806__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacacgccccggaagaacgacuccucguccaucagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggucgaacccgaaguccaagcugcagaucaaccgccaggugaucguggaccgcggggaccggagcggcuacuccgggaucuucucggucgagggcaaguccugcaucaaccggugcuucuacguggagcugauccgcggccggaaggaggagaccgaggugcucuggaccagcaacucgaucgucguguucugcgggacguccggcaccuacgggaccggcagcuggcccgacggggccgaccugaaccugaugcccaucuga

SEQ ID NO: 27983 - RNA, 1410 nt, Artificial Sequence
  derived and/or modified CDS sequence (AUadapt) from InfluenzaA__AIJ10807__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggaggccuacgugagcugcgaccccgacaagugcuaccaguucgcccuggggcagggcaccacgcucaacaacgugcacuccaacaacaccguccgcgaccggaccccguaccgcacccugcugaugaacgagcucggcgugcccuuccaccuggggacgaagcaggucugcaucgccuggucguccagcuccugccacgacggcaaggcguggcugcacgugugcaucaccggggacgacaagaacgccaccgccucguucaucuacaacggccggcucguggacuccguggucagcugguccaaggagauccugcgcacccaggagucggagugcgugugcaucaacgggacgugcaccguggucaugaccgacggcuccgccagcggcaaggcggacaccaagauccuguucaucgaggaggggaagaucgugcacacgucgacccucuccggcucggcccagcacguggaggagugcuccugcuacccccgguaccccgggguccgcugcgugugccgggacaacuggaagggcagcaaccgcccgaucguggacaucaacaucaaggaccacuccaucgucucguccuacgugugcagcggccuggugggggacacgccccggaagaacgacuccucguccagcucccacugccuggaccccaacaacgaggagggcgggcacggcgucaaggggugggccuucgacgacggcaacgacguguggaugggccgcaccaucaacgagaccucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggccggacggggccgaccugaaccugaugcccaucuga

SEQ ID NO: 27984 - RNA, 1410 nt, Artificial Sequence
  derived and/or modified CDS sequence (AUadapt) from InfluenzaA__AIJ10808__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggaggugcugcgcacccaggagucggagugcgugugcaucaacgggacgugcaccgucgugaugaccgacggcuccgccagcggcaaggccgacaccaagauccuguucaucgaggaggggaagaucgugcacacgucgacccucuccggcucggcgcagcacgucgaggagugcuccugcuacccccgguacccgggggugcgcugcgugugccgggacaacuggaagggcagcaaccgccccaucgucgacaucaacaucaaggaccacuccaucgugucguccuacgugugcagcggccuggucggggacaccccgcggaagaacgacuccucguccagcucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggugaucgucgaccgcggggaccgguccggcuacucggggaucuucuccguggagggcaagagcugcaucaaccggugcuucuacguggagcugauccgcggccggaaggaggagaccgagguccucuggaccucgaacuccaucgugguguucugcgggacgagcggcaccuacgggaccggcuccuggcccgacggggccgaccugaaccugaugcccaucuga

SEQ ID NO: 27985 - RNA, 1410 nt, Artificial Sequence; identical to SEQ ID NO: 16339
  derived and/or modified CDS sequence (AUadapt) from InfluenzaA__AIJ10809__NA

SEQ ID NO: 27986 - RNA, 1410 nt, Artificial Sequence; identical to SEQ ID NO: 16339
  derived and/or modified CDS sequence (AUadapt) from InfluenzaA__AIJ10810__NA

SEQ ID NO: 27987 - RNA, 1410 nt, Artificial Sequence
  derived and/or modified CDS sequence (AUadapt) from InfluenzaA__AIJ10812__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucauggagcgcaacgugaccgagaucgucuaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccgucgugagcugguccaaggagauccugcgcacccaggagucggagugcgugugcaucaacgggacgugcaccgucgugaugaccgacggcuccgccagcggcaaggccgacaccaagauccuguucaucgaggaggggaagaucgugcacacgucgacccucuccggcucggcgcagcacgucgaggagugcuccugcuacccccgguacccgggggugcgcugcgugugccgggacaacuggaagggcagcaaccgccccaucgucgacaucaacaucaaggaccacuccaucgugucguccuacgugugcagcggccuggucggggacaccccgcggaagaacgacuccucguccagcucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggugaucgucgaccgcggggaccgguccggcuacucggggaucuucuccguggagggcaagagcugcaucaaccggugcuucuacguggagcugauccgcggccggaaggaggagaccgagguccucuggaccucgaacuccaucgugguguucugcgggacgagcggcaccuacgggaccggcuccuggcccgacggggccgaccugaaccugaugcccaucuga

SEQ ID NO: 27988 - RNA, 1410 nt, Artificial Sequence
  derived and/or modified CDS sequence (AUadapt) from InfluenzaA__AIJ10813__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucauggagcgcaacgugaccgagaucgucuaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggugacccgggagcccuacgugagcugcgacccggacaagugcuaccaguucgcccuggggcagggcaccacgcucaacaacguccacuccaacaaccccgugcgcgaccggacccccuaccgcacccugcugaugaacgagcucggcgugcccuuccaccuggggaccaagcaggucugcaucgccuggucguccagcuccugccacgacggcaaggccuggcugcacgugugcaucacgggggacgacaagaacgcgaccgccucguucaucuacaacggccggcucguggacuccgucgugagcugguccaaggagauccugcgcacccaggagucggagugcgugugcaucaacgggaccugcacggucgugaugaccgacggcuccgccagcggcaaggccgacaccaagauccuguucaucgaggaggggaagaucgugcacaccucgacgcucuccggcucggcgcagcacgucgaggagugcuccugcuacccgcgguaccccggggugcgcugcgugugccgggacaacuggaagggcagcaaccgccccaucgucgacaucaacaucaaggaccacuccaucgugucguccuacgugugcagcggccuggucggggacacgccccggaagaacgacuccucguccagcucccacugccuggacccgaacaacgaggagggcgggcacggcgugaaggggugggccuucgacgacggcaacgacgucuggaugggccgcaccaucaacgagaccucgcggcucggguacgagaccuucaaggugaucgagggcugguccaaccccaagagcaagcugcagaucaaccgccaggugaucgucgaccgcggggaccgguccggcuacucggggaucuucuccguggagggcaagagcugcaucaaccggugcuucuacguggagcugauccgcggccggaaggaggagaccgagguccucuggaccucgaacuccaucgugguguucugcgggaccagcggcacguacgggaccggcuccuggcccgacggggccgaccugaaccugaugcccaucuga

SEQ ID NO: 27989 - RNA, 1410 nt, Artificial Sequence
  derived and/or modified CDS sequence (AUadapt) from InfluenzaA__AIJ10814__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucguggagcgcaacaucaccgagaucgucuaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccgucgugagcugguccaaggagauccugcgcacccaggagucggagugcgugugcaucaacgggacgugcaccgucgugaugaccgacggcuccgccagcggcaaggccgacaccaagauccuguucaucgaggaggggaagaucgugcacacgucgacccucuccggcucggcgcagcacgucgaggagugcuccugcuacccccgguacccgggggugcgcugcgugugccgggacaacuggaagggcagcaaccgccccaucgucgacaucaacaucaaggaccacuccaucgugucguccuacgugugcagcggccuggucggggacaccccgcggaagaacgacuccucguccagcucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggugaucgucgacaagggggaccgguccggcuacucggggaucuucuccguggagggcaagagcugcaucaaccgcugcuucuacguggagcugauccggggccgcaaggaggagaccgagguccucuggaccucgaacuccaucgugguguucugcgggacgagcggcaccuacgggaccggcuccuggcccgacggggccgaccugaaccugaugcccaucuga

SEQ ID NO: 27990 - RNA, 1410 nt, Artificial Sequence
  derived and/or modified CDS sequence (AUadapt) from InfluenzaA__AIJ10815__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaacgaggugcucuggaccucgaacuccaucgucguguucugcgggaccagcggcacguacgggaccggcuccuggcccgacggggccgaccugaaccugaugcccaucuga

SEQ ID NO: 27991 - RNA, 1410 nt, Artificial Sequence
  derived and/or modified CDS sequence (AUadapt) from InfluenzaA__AIJ10816__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggagauccugcgcacccaggagagcgagugcgugugcaucaacgggacgugcaccguggucaugaccgacggcuccgccucgggcaaggccgacaccaagauccuguucaucgaggaggggaagaucgugcacacgagcacccucuccggcucggcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacaccccgcggaagaacgacuccagcuccucgucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagggcugcaucaaccggugcuucuacguggagcugauccgcgggcggaaggaggagaccgaggugcucuggaccagcaacucgaucgucguguucugcggcacguccgggaccuacggcaccgggagcuggcccgacggcgccgaccugaaccugaugcccaucuga

SEQ ID NO: 27992 - RNA, 1410 nt, Artificial Sequence; identical to SEQ ID NO: 16339
  derived and/or modified CDS sequence (AUadapt) from InfluenzaA__AIJ10817__NA

SEQ ID NO: 27993 - RNA, 1410 nt, Artificial Sequence; identical to SEQ ID NO: 16339
  derived and/or modified CDS sequence (AUadapt) from InfluenzaA__AIJ10818__NA

SEQ ID NO: 27994 - RNA, 1410 nt, Artificial Sequence
  derived and/or modified CDS sequence (AUadapt) from InfluenzaA__AIJ10819__NA
augaaccccaaccagaagaucaucaccaucggcucggugucccugaccaucucgacgaucugcuucuucaugcagaucgccauccucaucaccaccgucgcccugcacuucaagcaguacgaguucaacuccccgcccaacaaccaggugaugcugugcgagcccaccaucaucgagcgcaacaucacggagaucguguaccucaccaacaccaccaucgagaaggagaucugccccaagccggcggaguaccggaacuggagcaagccccagugcgggaucacgggcuucgcccccuucuccaaggacaacucgauccgccuguccgccgggggcgacaucugggucacccgggagcccuacgugagcugcgacccggacaagugcuaccaguucgcccuggggcagggcaccacccucaacaacgugcacuccaacaacacgguccgcgaccggacccccuaccgcacccugcugaugaacgagcucggcgugcccuuccaccuggggaccaagcaggucugcaucgccuggucguccagcuccugccacgacggcaaggcguggcugcacgugugcaucacgggggacgacaagaacgccaccgccucguucaucuacaacggccggcucguggacuccguggucagcugguccaaggagauccugcgcacccaggagucggagugcgugugcaucaacgggaccugcacgguggucaugaccgacggcuccgccagcggcaaggcgaacaccaagauccuguucaucgaggaggggaagaucgugcacaccucgacgcucuccggcucggcccagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagaccucgcggcucggguacgagacguucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggaccagcggcacguacgggaccggcuccuggcccgacggggccgaccugaaccugaugcccaucuga

SEQ ID NO: 27995 - RNA, 1410 nt, Artificial Sequence; identical to SEQ ID NO: 16339
  derived and/or modified CDS sequence (AUadapt) from InfluenzaA__AIJ10820__NA

SEQ ID NO: 27996 - RNA, 1410 nt, Artificial Sequence; identical to SEQ ID NO: 16339
  derived and/or modified CDS sequence (AUadapt) from InfluenzaA__AIJ10821__NA

SEQ ID NO: 27997 - RNA, 1410 nt, Artificial Sequence
  derived and/or modified CDS sequence (AUadapt) from InfluenzaA__AIJ10822__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggacauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaacgaggugcucuggaccucgaacuccaucgucguguucugcgggaccagcggcacguacgggaccggcuccuggcccgacggggccgaccugaaccugaugcccaucuga

SEQ ID NO: 27998 - RNA, 1410 nt, Artificial Sequence
  derived and/or modified CDS sequence (AUadapt) from InfluenzaA__AIJ10823__NA
augaaccccaaccagaagaucaucaccaucggcucggugucccugaccaucagcacgaucugcuucuucaugcagaucgccauccucaucaccaccgucacccugcacuucaaccaguacgaguucaacuccccgcccaacaaccaggugaugcugugcgagcccacgaucaucgagcgcaacaucaccgagaucguguaccucaccaccacgaccaucgagaaggagaucugccccaagccggccgaguaccggaacuggucgaagccccagugcgggaucaccggcuucgcgcccuucuccaaggacaacagcauccgccuguccgccgggggcgacaucugggucacccgggagcccuacgugucgugcgacccggacaagugcuaccaguucgcccuggggcagggcacgacccucaacaacgugcacuccaacaacaccguccgcgaccggacccccuuccgcacgcugcugaugaacgagcucggcgugcccuuccaccuggggaccaagcaggucugcaucgccuggagcuccucguccugccacgacggcaaggccuggcugcacgugugcaucaccggggacgacaagaacgcgaccgccagcuucaucuacaacggccggcucguggacuccguggucucgugguccaaggagauccugcgcacgcaggagagcgagugcgugugcaucaacgggaccugcaccguggucaugaccgacggcuccgccucgggcaaggccgugacgaagauccuguucaucgaggaggggaagaucgugcacaccagcacccucuccggcucggcgcagcacgucgaggagugcuccugcuacccccgguacccgggggugcgcugcgugugccgggacaacuggaagggcagcaaccgccccaucgucgacaucaacaucaaggaccacuccaucgugucgggcuacgugugcuccgggcuggucggcgacacgccccggaagaacgacagcuccucguccagccacugccugaaccccaacaacgaggagggcgggcacggggugaagggcugggccuucgacgacggcaacgacgucuggauggggcgcaccaucaacgagaccucccggcucggcuacgagaccuucaaggugaucgagggguggucgaacccgaaguccaagcugcagaucaaccgccaggugaucgucgaccggggcgaccgcagcggguacuccggcaucuucucgguggagggcaaguccugcaucaaccggugcuucuacguggagcugauccgcgggcggaaggaggagaccgagguccucuggacgagcaacucgaucgugguguucugcggcaccuccgggaccuacggcaccgggagcuggcccgacggcgccgaccugaaccugaugcccaucuga

SEQ ID NO: 27999 - RNA, 1410 nt, Artificial Sequence
  derived and/or modified CDS sequence (AUadapt) from InfluenzaA__AIJ10824__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccagguggugcugugcgagcccacgaucaucgagcgcaacaucaccgagaucgucuaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccgucgugagcugguccaaggagauccugcgcacccaggagucggagugcgugugcaucaacgggacgugcaccgucgugaugaccgacggcuccgccagcggcaaggccgacaccaagauccuguucaucgaggaggggaagaucgugcacacgucgacccucuccggcucggcgcagcacgucgaggagugcuccugcuacccccgguacccgggggugcgcugcgugugccgggacaacuggaagggcagcaaccgccccaucgucgacaucaacaucaaggaccacuccaucgugucguccuacgugugcagcggccuggucggggacaccccgcggaagaacgacuccucguccagcucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggugaucgucgaccgcggggaccgguccggcuacucggggaucuucuccguggagggcaagagcugcaucaaccggugcuucuacguggagcugauccgcggccggaaggaggagaccgagguccucuggaccucgaacuccaucgugguguucugcgggacgagcggcaccuacgggaccggcuccuggcccgacggggccgaccugaaccugaugcccaucuga

SEQ ID NO: 28000 - RNA, 1410 nt, Artificial Sequence
  derived and/or modified CDS sequence (AUadapt) from InfluenzaA__AIJ10827__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggacauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccaucgagggcaagagcugcaucaaccggugcuucuacgucgagcugauccgcggccggaaggaggagaccgaggugcucuggaccucgaacuccaucguggucuucugcgggacgagcggcaccuacgggaccggcuccuggcccgacggggccgaccugaaccugaugcccaucuga

SEQ ID NO: 28001 - RNA, 1410 nt, Artificial Sequence
  derived and/or modified CDS sequence (AUadapt) from InfluenzaA__AIJ10828__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggacauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccaucgagggcaagagcugcaucaaccggugcuucuacgucgagcugauccgcggccggaaggaggagaccgaggugguguggaccucgaacuccaucgucguguucugcgggacgagcggcaccuacgggaccggcuccuggcccgacggggccgaccucaaccugaugcccaucuga

SEQ ID NO: 28002 - RNA, 1410 nt, Artificial Sequence
  derived and/or modified CDS sequence (AUadapt) from InfluenzaA__AIJ10829__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaacugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggacauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgaccacggggucaagggcugggccuucgacgacgggaacgacguguggaugggccgcaccaucaacgagacgucgcggcucggcuacgagaccuucaaggucaucgaggggugguccaaccccaagagcaagcugcagaucaaccgccaggugaucguggaccggggcgaccgcuccggguacucgggcaucuucuccaucgagggcaagagcugcaucaaccggugcuucuacgucgagcugauccgcgggcggaaggaggagaccgaggugcucuggaccucgaacuccaucguggucuucugcggcacgagcgggaccuacggcaccggguccuggcccgacggcgccgaccugaaccugaugcccaucuga

SEQ ID NO: 28003 - RNA, 1410 nt, Artificial Sequence
  derived and/or modified CDS sequence (AUadapt) from InfluenzaA__AIJ10830__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguacaagaacuggagcaagccccagugcgggaucaccggcuucgcgcccuucuccaaggacaacucgauccggcuguccgccgggggcgacaucugggucacccgcgagcccuacgugagcugcgacccggacaagugcuaccaguucgcccuggggcagggcaccacgcucaacaacgugcacuccaacaacaccguccgggaccgcacccccuaccggacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccgccucguggacuccguggucagcugguccaaggacauccugcggacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgcuacccggggguccggugcgugugccgcgacaacuggaagggcagcaaccggcccaucguggacaucaacaucaaggaccacuccaucgucucguccuacgugugcagcggccuggugggggacaccccgcgcaagaacgacuccucguccagcucccacugccuggaccccaacaacgaggagggcgggcacggcgucaaggggugggccuucgacgacggcaacgacguguggaugggccggaccaucaacgagacgucgcgccucggguacgagaccuucaaggucaucgagggcugguccaaccccaagagcaagcugcagaucaaccggcaggucaucguggaccgcggggaccgguccggcuacucggggaucuucuccaucgagggcaagagcugcaucaaccgcugcuucuacguggagcugauccggggccgcaaggaggagaccgaggugcucuggaccucgaacuccaucguggucuucugcgggacgagcggcaccuacgggaccggcuccuggcccgacggggccgaccugaaccugaugcccaucuga

SEQ ID NO: 28004 - RNA, 1410 nt, Artificial Sequence; identical to SEQ ID NO: 28000
  derived and/or modified CDS sequence (AUadapt) from InfluenzaA__AIJ10831__NA

SEQ ID NO: 28005 - RNA, 1410 nt, Artificial Sequence; identical to SEQ ID NO: 28000
  derived and/or modified CDS sequence (AUadapt) from InfluenzaA__AIJ10832__NA

SEQ ID NO: 28006 - RNA, 1410 nt, Artificial Sequence
  derived and/or modified CDS sequence (AUadapt) from InfluenzaA__AIJ10834__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggacauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcagcgcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacaccccgcggaagaacgacuccagcuccucgucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagucgaagcugcagaucaaccgccaggugaucguggaccgcggggaccgguccggcuacagcgggaucuucuccaucgagucgaagagcugcaucaaccggugcuucuacgucgagcugauccgcggccggaaggaggagaccgaggugcucuggaccuccaacucgaucguggucuucugcggcacguccgggaccuacggcaccgggagcuggcccgacggcgccgaccugaaccugaugcccaucuga

SEQ ID NO: 28007 - RNA, 1410 nt, Artificial Sequence
  derived and/or modified CDS sequence (AUadapt) from InfluenzaA__AIJ10835__NA
augaaccccaaccagaagaucaucaccaucggcucggugucccugaccaucucgacgaucugcuucuucaugcagaucgccauccucaucaccaccgucacccugcacuucaagcaguacgaguucaacuccacgccgaacaaccaggugaugcugugcgagcccaccaucaucgagcgcaacaucaccgagaucguguaccucaccaacacgaccaucgagaaggagaucugccccaagcccgccgaguaccggaacuggagcaagccgcagugcgggaucaccggcuucgcgcccuucuccaaggacaacucgauccgccuguccgccgggggcgacaucugggucacccgggagcccuacgugagcugcgaccccgacaagugcuaccaguucgcccuggggcagggcacgacccucaacaacgugcacuccaacaacaccguccgcgaccggaccccguaccgcacgcugcugaugaacgagcucggcgugcccuuccaccuggggaccaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggacauccugcgcacgcaggagucggagugcgugugcaucaacgggaccugcaccguggucaugaccgacggcuccgccagcggcaaggccgacacgaagauccuguucaucgaggaggggaagaucgugcacaccucgacccucuccggcucggcgcagcacguggaggagugcuccugcuacccccgguaccccgggguccgcugcgugugccgggacaacuggaagggcagcaaccgcccgaucguggacaucaacaucaaggaccacuccaucgucucguccuacgugugcagcggccuggugggggacacgccccggaagaacgacuccucguccagcucccacugccuggaccccaacaacgaggagggcgggcacggcgucaaggggugggccuucgacgacggcaacgacguguggaugggccgcaccaucaacgagaccucgcggcucggguacgagaccuucaaggucaucgagggcugguccaaccccaagagcaagcugcagaucaaccgccaggugaucguggaccgcggggaccgguccggcuacucggggaucuucuccaucgagggcaagagcugcaucaaccggugcuucuacgucgagcugauccgcggccggaaggaggagaccgaggugcucuggacgucgaacuccaucguggucuucugcgggaccagcggcaccuacgggaccggcuccuggccggacggggccgaccugaaccugaugcccaucuga

SEQ ID NO: 28008 - RNA, 1410 nt, Artificial Sequence; identical to SEQ ID NO: 28000
  derived and/or modified CDS sequence (AUadapt) from InfluenzaA__AIJ10836__NA

SEQ ID NO: 28009 - RNA, 1410 nt, Artificial Sequence
  derived and/or modified CDS sequence (AUadapt) from InfluenzaA__AIJ10837__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggacauccugcgcacccaggagucggagugcgugugcaucaacgggacgugcaccguggucaugaccgacggcuccgccagcggcaaggccgacaccaagauccuguucaucgaggaggggaagaucauccacacgucgacccucuccggcucggcgcagcacguggaggagugcuccugcuacccccgguacccgggggugcgcugcgucugccgggacaacuggaagggcagcaaccgccccaucguggacaucaacaucaaggaccacuccaucgugucguccuacgucugcagcggccuggugggggacaccccgcggaagaacgacuccucguccagcucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaaccgccaggucaucguggaccgcggggaccgguccggcuacucggggaucuucuccaucgagggcaagagcugcaucaaccggugcuucuacguggagcugauccgcggccggaaggaggagaccgagguccucuggaccucgaacuccaucgugguguucugcgggacgagcggcaccuacgggaccggcuccuggcccgacggggccgaccugaaccugaugcccaucuga

SEQ ID NO: 28010 - RNA, 1410 nt, Artificial Sequence; identical to SEQ ID NO: 28000
  derived and/or modified CDS sequence (AUadapt) from InfluenzaA__AIJ10838__NA

SEQ ID NO: 28011 - RNA, 1410 nt, Artificial Sequence
  derived and/or modified CDS sequence (AUadapt) from InfluenzaA__AIJ10841__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggacauccugcgcacccaggagucggagugcgugugcaucaacgggacgugcaccguggucaugaccgacggcuccgccagcggcgaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccaucgagggcaagagcugcaucaaccggugcuucuacgucgagcugauccgcggccggaaggaggagaccgaggugcucuggaccucgaacuccaucguggucuucugcgggacgagcggcaccuacgggaccggcuccuggcccgacggggccgaccugaaccugaugcccaucuga

SEQ ID NO: 28012 - RNA, 1410 nt, Artificial Sequence
  derived and/or modified CDS sequence (AUadapt) from InfluenzaA__AIJ10842__NA
augaaccccaaccagaagaucaucaccaucggcucggugucccugaccaucucgacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcccgccgaguaccggaacugguccaagccccagugcgggaucaccggcuucgcgcccuucagcaaggacaacuccauccgccugucggccgggggcgacaucugggucacccgggagccguacguguccugcgaccccgacaagugcuaccaguucgcccuggggcagggcaccacgcucaacaacgugcacagcaacaacaccguccgcgaccggacccccuaccgcacccugcugaugaacgagcucggcgugcccuuccaccuggggacgaagcaggucugcaucgccugguccucguccucgugccacgacggcaaggccuggcugcacgugugcaucaccggggacgacaagaacgcgaccgccuccuucaucuacaacggccggcucguggacagcguggucuccuggucgaaggacauccugcgcacccaggaguccgagugcgugugcaucaacgggacgugcaccguggucaugaccgacggcagcgccuccggcaaggccgacaccaagauccuguucaucgaggaggggaagaucgugcacacgucgacccucagcggcuccgcgcagcacguggaggagugcucgugcuacccgcgguaccccgggguccgcugcgugugccgggacaacuggaagggcuccaaccgccccaucguggacaucaacaucaaggaccacucgaucgucuccagcuacgugugcuccggccuggugggggacacgccccggaagaacgacucguccagcuccucgcacugccuggacccgaacaacgaggagggcgggcacggcgucaaggggugggccuucgacgacggcaacgacguguggaugggccgcaccaucaacgagaccucccggcucggguacgagaccuucaaggucaucgagggcuggucgaaccccaaguccaagcugcagaucaaccgccaggugaucguggaccgcggggaccggagcggcuacuccgggaucuucucgaucgagggcaaguccugcaucaaccggugcuucuacgucgagcugauccgcggccggaaggaggagaccgaggugcucuggaccagcaacucgaucguggucuucugcgggacguccggcaccuacgggaccggcagcuggcccgacggggccgaccugaaccugaugcccaucuga

SEQ ID NO: 28013 - RNA, 1410 nt, Artificial Sequence; identical to SEQ ID NO: 28000
  derived and/or modified CDS sequence (AUadapt) from InfluenzaA__AIJ10843__NA

SEQ ID NO: 28014 - RNA, 1410 nt, Artificial Sequence
  derived and/or modified CDS sequence (AUadapt) from InfluenzaA__AIJ10844__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuuccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgugaccaagauccuguucaucgaggaggggaagaucgugcacacgucgacccucuccggcagcgcgcagcacgucgaggagugcuccugcuacccccgguacccgggggugcgcugcgugugccgggacaacuggaagggcucgaaccgccccaucgucgacaucaacaucaaggaccacuccaucgugagcggcuacgugugcuccgggcuggucggcgacaccccgcggaagaacgacucguccagcuccgggcacugccuggaccccaacaacgaggagggcgggcacggcgugaagggcugggccuucgacgacgggaacgacgucuggaugggccgcaccaucaacgagacgucgcggcucggguacgagaccuucaaggugaucaagggcugguccaaccccaagagcaagcugcagaucaaccgccaggugaucgucgaccgcggggaccgguccggcuacucgggcaucuucuccguggagggcaagagcugcaucaaccggugcuucuacguggagcugauccgcgggcggaaggaggagaccgagguccucuggaccuccaacucgaucgugguguucugcgggacgagcggcaccuacgggaccggcuccuggcccgacggcgccgaccugaaccugaugcccaucuga

SEQ ID NO: 28015 - RNA, 1410 nt, Artificial Sequence
  derived and/or modified CDS sequence (AUadapt) from InfluenzaA__AIJ10845__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccaucaucgagaaggagaucugccccaagccggccgaguaccggaacuggucgaagccccagugcgggaucacgggcuucgcgcccuucuccaaggacaacagcauccgccuguccgccgggggcgacaucugggucacccgggagcccuacgugucgugcgacccggacaagugcuaccaguucgcccuggggcagggcaccacccucaacaacgugcacuccaacaacacgguccgcgaccggacccccuuccgcacccugcugaugaacgagcucggcgugcccuuccaccuggggaccaagcaggucugcaucgccuggagcuccucguccugccacgacggcaaggccuggcugcacgugugcaucacgggggacgacaagaacgcgaccgccagcuucaucuacaacggccggcucguggacuccguggucucgugguccaaggagauccugcgcacccaggagagcgagugcgugugcaucaacgggaccugcacgguggucaugaccgacggcuccgccucgggcaaggccgugaccaagauccuguucaucgaggaggggaagaucgugcacaccagcacgcucuccggcagcgcgcagcacgucgaggagugcuccugcuacccccgguacccgggggugcgcugcgugugccgggacaacuggaagggcucgaaccgccccaucgucgacaucaacaucaaggaccacuccaucgugagcggcuacgugugcuccgggcuggucggcgacacgccccggaagaacgacucguccagcuccucgcacugccuggaccccaacaacgaggagggcgggcacggggugaagggcugggccuucgacgacggcaacgacgucuggauggggcgcaccaucaacgagaccucccggcucggcuacgagaccuucaaggugaucgagggguggagcaacccgaaguccaagcugcagaucaaccgccaggugaucgucgaccggggcgaccgcucgggguacuccggcaucuucagcguggagggcaaguccugcaucaaccggugcuucuacguggagcugauccgcgggcggaaggaggagaccgagguccucuggaccucgaacagcaucgugguguucugcggcaccuccgggacguacggcaccgggagcuggcccgacggcgccgaccugaaccugaugcccaucuga

SEQ ID NO: 28016 - RNA, 1410 nt, Artificial Sequence
  derived and/or modified CDS sequence (AUadapt) from InfluenzaA__AIJ10847__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggucgaagccccagugcgggaucaccggcuucgcgcccuucuccaaggacaacagcauccgccuguccgccgggggcgacaucugggucacccgggagcccuacgugucgugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccucguccugccacgacggcaaggccuggcugcacgugugcaucaccggggacgacaagaacgcgaccgccagcuucaucuacaacggccggcucguggacuccguggucucgugguccaaggacauccugcgcacccaggagagcgagugcgugugcaucaacgggacgugcaccguggucaugaccgacggcuccgccucgggcaaggccgacaccaagauccuguucaucgaggaggggaagaucgugcacacgagcacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacacgccccggaagaacgacuccuucucguccagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggucgaacccgaaguccaagcugcagaucaaccgccaggugaucguggaccgcggggaccggagcggcuacuccgggaucuucucgaucgagggcaaguccugcaucaaccggugcuucuacgucgagcugauccgcggccggaaggaggagaccgaggugcucuggaccagcaacucgaucguggucuucugcgggacguccggcaccuacgggaccggcagcuggcccgacggggccgaccugaaccugaugcccaucuga

SEQ ID NO: 28017 - RNA, 1410 nt, Artificial Sequence; identical to SEQ ID NO: 28000
  derived and/or modified CDS sequence (AUadapt) from InfluenzaA__AIJ10848__NA

SEQ ID NO: 28018 - RNA, 1410 nt, Artificial Sequence
  derived and/or modified CDS sequence (AUadapt) from InfluenzaA__AIJ10849__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggucgaagccccagugcgggaucaccggcuucgcgcccuucuccaaggacaacagcauccgccuguccgccgggggcgacaucugggucacccgggagcccuacgugucgugcgacccggacaagugcuaccaguucgcccuggggcagggcaccacgcucaacaacgugcacuccaacaacaccguccgcgaccggacccccuuccgcacccugcugaugaacgagcucggcgugcccuuccaccuggggacgaagcaggucugcaucgccuggagcuccucguccugccacgacggcaaggccuggcugcacgugugcaucaccggggacgacaagaacgcgaccgccagcuucaucuacaacggccggcucguggacuccguggucucgugguccaaggagauccugcgcacccaggagagcgagugcgugugcaucaacgggacgugcaccguggucaugaccgacggcuccgccucgggcaaggccgugaccaagauccuguucaucgaggaggggaagaucgugcacacgagcacccucuccggcucggcgcagcacgucgaggagugcuccugcuacccccgguacccgggggugcgcugcgugugccgggacaacuggaagggcagcaaccgccccaucgucgacaucaacaucaaggaccacuccaucgugucgggcuacgugugcuccgggcuggucggcgacacgccccggaagaacgacagcuccucguccagccacugccuggaccccaacaacgaggagggcgggcacggggugaagggcugggccuucgacgacggcaacgacgucuggauggggcgcaccaucaacgagaccucccggcucggcuacgagaccuucaaggugaucgagggguggucgaacccgaaguccaagcugcagaucaaccgccaggugaucgucgaccggggcgaccgcagcggguacuccggcaucuucucgguggagggcaaguccugcaucaaccggugcuucuacguggagcugauccgcgggcggaaggaggagaccgagguccucuggaccagcaacucgaucgugguguucugcggcacguccgggaccuacggcaccgggagcuggcccgacggcgccgaccugaaccugaugcccaucuga

SEQ ID NO: 28019 - RNA, 1410 nt, Artificial Sequence; identical to SEQ ID NO: 28018
  derived and/or modified CDS sequence (AUadapt) from InfluenzaA__AIJ10851__NA

SEQ ID NO: 28020 - RNA, 1410 nt, Artificial Sequence; identical to SEQ ID NO: 28018
  derived and/or modified CDS sequence (AUadapt) from InfluenzaA__AIJ10852__NA

SEQ ID NO: 28021 - RNA, 1410 nt, Artificial Sequence; identical to SEQ ID NO: 28014
  derived and/or modified CDS sequence (AUadapt) from InfluenzaA__AIJ10853__NA

SEQ ID NO: 28022 - RNA, 1410 nt, Artificial Sequence; identical to SEQ ID NO: 28014
  derived and/or modified CDS sequence (AUadapt) from InfluenzaA__AIJ10854__NA

SEQ ID NO: 28023 - RNA, 1410 nt, Artificial Sequence
  derived and/or modified CDS sequence (AUadapt) from InfluenzaA__AIJ10855__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggucgaagccccagugcgggaucaccggcuucgcgcccuucuccaaggacaacagcauccgccuguccgccgggggcgacaucugggucacccgggagcccuacgugucgugcgacccggacaagugcuaccaguucgcccuggggcagggcaccacgcucaacaacgugcacuccaacaacaccguccgcgaccggacccccuuccgcacccugcugaugaacgagcucggcgugcccuuccaccuggggacgaagcaggucugcaucgccuggagcuccucguccugccacgacggcaaggccuggcugcacgugugcaucaccggggacgacaagaacgcgaccgccagcuucaucuacaacggccggcucguggacuccguggucucgugguccaaggagauccugcgcacccaggagagcgagugcgugugcaucaacgggacgugcaccguggucaugaccgacggcuccgccucgggcaaggccgugaccaagauccuguucaucgaggaggggaagaucgugcacacgagcacccucuccggcucggcgcagcacgucgaggagugcuccugcuacccccgguacccgggggugcgcugcgugugccgggacaacuggaagggcagcaaccgccccaucgucgacaucaacaucaaggaccacuccaucgugucgggcuacgugugcuccgggcuggucggcgacacgccccggaagaacgacagcuccucguccagccacugccuggaccccaacaacgaggagggggaccacggcgugaaggggugggccuucgacgacggcaacgacgucuggaugggccgcaccaucaacgagaccucccggcucggguacgagaccuucaaggugaucgagggcuggucgaacccgaaguccaagcugcagaucaaccgccaggugaucgucgaccgcggggaccggagcggcuacuccgggaucuucucgguggagggcaaguccugcaucaaccggugcuucuacguggagcugauccgcggccggaaggaggagaccgagguccucuggaccagcaacucgaucgugguguucugcgggacguccggcaccuacgggaccggcagcuggcccgacggggccgaccugaaccugaugcccaucuga

SEQ ID NO: 28024 - RNA, 1410 nt, Artificial Sequence
  derived and/or modified CDS sequence (AUadapt) from InfluenzaA__AIJ10856__NA
augaaccccaacaagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaagaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggacauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcagcgcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacaccccgcggaagaacgacuccuucagcuccggccacugccuggaccccaacaacgaggagggcgggcacggggucaagggcugggccuucgacgacggcaacgacguguggauggggcgcaccaucaacgagacgucgcggcucggcuacgagaccuucaaggucaucgaggggugguccaaccccaagagcaagcugcagaucaaccgccaggugaucguggaccggggcgaccgcuccggguacucgggcaucuucuccaucgagggcaagagcugcaucaaccggugcuucuacgucgagcugauccgcgggcggaaggaggagaccgaggugcucuggaccuccaacucgaucguggucuucugcggcacgagcgggaccuacggcaccggguccuggcccgacggcgccgaccugaaccugaugcccaucuga

SEQ ID NO: 28025 - RNA, 1410 nt, Artificial Sequence; identical to SEQ ID NO: 28000
  derived and/or modified CDS sequence (AUadapt) from InfluenzaA__AIJ10857__NA

SEQ ID NO: 28026 - RNA, 1410 nt, Artificial Sequence; identical to SEQ ID NO: 16339
  derived and/or modified CDS sequence (AUadapt) from InfluenzaA__AIJ29348__NA

SEQ ID NO: 28027 - RNA, 1410 nt, Artificial Sequence; identical to SEQ ID NO: 16339
  derived and/or modified CDS sequence (AUadapt) from InfluenzaA__AIJ29350__NA

SEQ ID NO: 28028 - RNA, 1410 nt, Artificial Sequence
  derived and/or modified CDS sequence (AUadapt) from InfluenzaA__AIJ29352__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccaaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 28029 - RNA, 1410 nt, Artificial Sequence; identical to SEQ ID NO: 23545
  derived and/or modified CDS sequence (AUadapt) from InfluenzaA__AIJ29354__NA

SEQ ID NO: 28030 - RNA, 1410 nt, Artificial Sequence; identical to SEQ ID NO: 25324
  derived and/or modified CDS sequence (AUadapt) from InfluenzaA__AIJ29356__NA

SEQ ID NO: 28031 - RNA, 1410 nt, Artificial Sequence; identical to SEQ ID NO: 25324
  derived and/or modified CDS sequence (AUadapt) from InfluenzaA__AIJ29358__NA

SEQ ID NO: 28032 - RNA, 1410 nt, Artificial Sequence
  derived and/or modified CDS sequence (AUadapt) from InfluenzaA__AIJ29360__NA
augaaccccaaccagaagaucaucaccaucggcucggugucccugaccaucucgacgaucugcuucuucaugcagaucgccauccucaccaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcacgacccucaacaacgugcacuccaacaacaccguccgcgaccggacccccuaccgcacgcugcugaugaacgagcucggcgugcccuuccaccuggggaccaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggagauccugcgcacgcaggagagcgagugcgugugcaucaacgggaccugcaccguggucaugaccgacggcuccgccucgggcaaggccgacacgaagauccuguucaucgaggaggggaagaucgugcacaccagcacccucuccggcucggcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacaccccgcggaagaacgacuccagcuccucgucccacugccuggaccccaacaacgaggagggcgggcacggcgucaaggggugggccuucgacgacggcaacgacguguggaugggccgcacgaucaacgagaccucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggacgucgaacuccaucgucguguucugcgggaccagcggcaccuacgggaccggcuccuggcccgacggggccgaccugaaccugaugcccaucuga

SEQ ID NO: 28033 - RNA, 1410 nt, Artificial Sequence; identical to SEQ ID NO: 16339
  derived and/or modified CDS sequence (AUadapt) from InfluenzaA__AIJ29362__NA

SEQ ID NO: 28034 - RNA, 1410 nt, Artificial Sequence
  derived and/or modified CDS sequence (AUadapt) from InfluenzaA__AIL93626__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgaggccugcaaccaguccgucaucacguacgagaacaacaccuacgugaaccagaccuacgugaacaucagcaacaccaacuucgcggccggccgcuccgucgugagcgugaagcuggccgggaacuccucgcucugcccggucuccggcugggccaucuacagcaaggacaacuccgugcggaucggcagcaagggggacguguucgucauccgcgagcccuucaucuccugcagcccccuggagugccggacguucuuccugacccagggcgcccuccugaacgacaagcacuccaacgggaccaucaaggaccgcagccccuaccggacccugauguccugcccgaucggcgaggugcccagccccuacaacucgcgcuucgaguccguggcguggagcgccuccgccugccacgacgggaucaacuggcucacgaucggcaucagcggccccgacuccggggccgucgcggugcugaaguacaacggcaucaucaccgacaccaucaagagcuggaagaacaacauccugcggacccaggaguccgagugcgccugcgugaacgggagcugcuucacgaucaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcguguucggggacaacccgcggcccaacgacaagaccggcagcugcggccccgugcuguccaacggggccaacggcgucaagggguucagcuucaaguacggcaacgggguguggaucggccgcaccaagagcaucuccucgcggaagggcuucgagaugaucugggaccccaacggguggaccggcaccgacaacaacuucuccaucaagcaggacaucguggggaucaacgaguggagcggcuacuccgggagcuucguccagcacccggagcugaccggccucgacugcauccgccccugcuucuggguggagcugauccggggccgccccaaggagaacacgaucuggaccuccgggagcuccaucagcuucugcggcgucaacuccgacaccgugggguggagcuggcccgacggcgcggagcugccguucaccaucgacaaguga

SEQ ID NO: 28035 - RNA, 1410 nt, Artificial Sequence
  derived and/or modified CDS sequence (AUadapt) from InfluenzaA__AIL93648__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggcggaucgugcacacgucgacccucuccggcucggcgcagcacguggaggagugcuccugcuacccccgcuacccggggguccggugcgugugccgcgacaacuggaagggcagcaaccggcccaucguggacaucaacaucaaggaccacuccaucgucucguccuacgugugcagcggccuggugggggacaccccgcgcaagaacgacuccucguccagcucccacugccuggaccccaacaacgaggagggcgggcacggcgucaaggggugggccuucgacgacggcaacgacguguggaugggccggaccaucaacgagacgucgcgccucggguacgagaccuucaaggucaucgagggcugguccaaccccaagagcaagcugcagaucaacaagcaggucaucguggaccgcggggaccgguccggcuacucggggaucuucuccguggagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 28036 - RNA, 1410 nt, Artificial Sequence; identical to SEQ ID NO: 16339
  derived and/or modified CDS sequence (AUadapt) from InfluenzaA__AIL93660__NA

SEQ ID NO: 28037 - RNA, 1410 nt, Artificial Sequence; identical to SEQ ID NO: 16339
  derived and/or modified CDS sequence (AUadapt) from InfluenzaA__AIL93672__NA

SEQ ID NO: 28038 - RNA, 1410 nt, Artificial Sequence
  derived and/or modified CDS sequence (AUadapt) from InfluenzaA__AIL93684__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgaggccugcaaccaguccgucaucacguacgagaacaacaccugggugaaccagaccuacgugaacaucagcaacaccaacuccgcgacgggccagucggucguguccgugaagcuggccgggaacagcucccucugcccggucagcggcugggccaucuacuccaaggacaacagcgugcgcaucggcuccaagggggacguguucgucauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgaggugcccagccccuacaacucccgguucgagagcguggccugguccgcgagcgccugccacgacgggaucaacuggcucaccaucggcaucuccggccccgacucgggggccgucgccgugcugaaguacaacggcaucaucaccgacaccaucaaguccuggaagaacaacauccugcgcacgcaggagagcgagugcgcgugcgugaacggguccugcuucaccaucaugaccgacggcccgagcgacggccaggccuccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcucgaaccggcccugggucuccuucaaccagaaccucgaguaccagaucggguacaucugcagcggcguguucggggacaacccgcgccccaacgacaagaccggcuccugcggccccgugcugagcaacggggccaacggcgucaagggguucagcuucaaguacggcaacgggguguggaucggccggaccaaguccaucagcucccgcaagggcuucgagaugaucugggaccccaacggguggaccggcaccgacaacaacuucucgaucaagcaggacaucguggggaucaacgagugguccggcuacagcggguccuucguccagcacccggagcugacgggccucgacugcauccggcccugcuucuggaucgagcugauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 28039 - RNA, 1410 nt, Artificial Sequence
  derived and/or modified CDS sequence (AUadapt) from InfluenzaA__AIL93719__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaacaagcaggucaucguggaccgcggggaccgguccggcuacucggggaucuucuccguggagggcaagagcugcaucaaccgcugcuucuacguggagcugauccggggccgcaaggaggagaccgaggugcucuggaccucgaacuccaucgucguguucugcgggacgagcggcaccuacgggaccggcuccuggcccgacggggccgaccugaaccugaugcccaucuga

SEQ ID NO: 28040 - RNA, 1410 nt, Artificial Sequence; identical to SEQ ID NO: 28039
  derived and/or modified CDS sequence (AUadapt) from InfluenzaA__AIL93743__NA

SEQ ID NO: 28041 - RNA, 1410 nt, Artificial Sequence; identical to SEQ ID NO: 28039
  derived and/or modified CDS sequence (AUadapt) from InfluenzaA__AIL93755__NA

SEQ ID NO: 28042 - RNA, 1410 nt, Artificial Sequence; identical to SEQ ID NO: 16339
  derived and/or modified CDS sequence (AUadapt) from InfluenzaA__AIL93767__NA

SEQ ID NO: 28043 - RNA, 1410 nt, Artificial Sequence; identical to SEQ ID NO: 16339
  derived and/or modified CDS sequence (AUadapt) from InfluenzaA__AIL93779__NA

SEQ ID NO: 28044 - RNA, 1410 nt, Artificial Sequence
  derived and/or modified CDS sequence (AUadapt) from InfluenzaA__AIL93791__NA
augaaccccaaccagaagaucaucaccaucggcucggugucccugaccaucucgacgaucugcuucuucaugcagaucgccauccucaucaccaccgucacccugcacuucaagcaguacaaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggagauccugcgcacccaggagagcgagugcgugugcaucaacgggacgugcaccguggucaugaccgacggcuccgccucgggcaaggccgacaccaagauccuguucaucgaggaggggaagaucgugcacacgcggacccucagcggcuccgcgcagcacguggaggagugcucgugcuacccccgcuacccggggguccggugcgugugccgcgacaacuggaagggcuccaaccggcccaucguggacaucaacaucaaggaccacucgaucgucuccagcuacgugugcuccggccuggugggggacacgccccgcaagaacgacucguccagcuccucgcacugccuggaccccaacaacgaggagggcgggcacggcgucaaggggugggccuucgacgacggcaacgacguguggaugggccggaccaucaacgagaccucccgccucggguacgagaccuucaaggucaucgagggcuggucgaacccgaaguccaagcugcagaucaacaagcaggucaucguggaccgcggggaccggagcggcuacuccgggaucuucucgguggagggcaaguccugcaucaaccggugcuucuacguggagcugauccgcggccggaaggaggagaccgaggugcucuggaccagcaacucgaucgucguguucugcgggacguccggcaccuacgggaccggcagcuggcccgacggggccgaccugaaccugaugcccaucuga

SEQ ID NO: 28045 - RNA, 1410 nt, Artificial Sequence; identical to SEQ ID NO: 28039
  derived and/or modified CDS sequence (AUadapt) from InfluenzaA__AIL93803__NA

SEQ ID NO: 28046 - RNA, 1410 nt, Artificial Sequence
  derived and/or modified CDS sequence (AUadapt) from InfluenzaA__AIL93815__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucuacucguacgugugcuccggccuggugggggacacgccccggaagaacgacagcuccucguccagccacugccugaaccccaacaacgaggagggcgggcacggcgucaaggggugggccuucgacgacggcaacgacguguggaugggccgcaccaucaacgagaccucccggcucggguacgagaccuucaaggucaucgagggcuggucgaacccgaaguccaagcugcagaucaaccgccaggugaucguggaccgcggggaccggagcggcuacuccgggaucuucucggucgagggcaaguccugcaucaaccggugcuucuacguggagcugauccgcggccggaaggaggagaccgaggugcucuggaccagcaacucgaucgucguguucugcgggacguccggcaccuacgggaccggcagcuggcccgacggggccgaccugaaccugaugcccaucuga

SEQ ID NO: 28047 - RNA, 1410 nt, Artificial Sequence; identical to SEQ ID NO: 16339
  derived and/or modified CDS sequence (AUadapt) from InfluenzaA__AIL93827__NA

SEQ ID NO: 28048 - RNA, 1410 nt, Artificial Sequence
  derived and/or modified CDS sequence (AUadapt) from InfluenzaA__AIL93839__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgaggccugcaaccaguccgucaucacguacgagaacaacaccugggugaaccagaccuacgugaacaucagcaacaccaacuucgcgacgggccaguccgucgugagcgugaagcuggccgggaacuccucgcucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacucgcgguucgaguccguggccuggagcgcguccgccugccacgacgggaucaacuggcucaccaucggcaucagcggccccgacuccggggccgucgccgugcugaaguacaacggcaucaucaccgacaccaucaagagcuggaagaacaacauccugcgcacgcaggaguccgagugcgcgugcgugaacgggagcugcuucaccaucaugaccgacggcccguccgacggccaggccagcuacaagaucuuccggaucgagaaggggaagaucgucaaguccguggagaugaacgcccccaacuaccacuacgaggagugcucgugcuaccccgacuccagcgagaucacgugcgugugccgcgacaacuggcacggcuccaaccggcccugggucagcuucaaccagaaccucgaguaccagaucggguacaucugcuccggcguguucggggacaacccgcgccccaacgacaagaccggcagcugcggccccguguccagcaacggggccaacggcgucaagggguucagcuucaaguacggcaacgggguguggaucggccggaccaaguccaucucgucccgcaagggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 28049 - RNA, 1410 nt, Artificial Sequence
  derived and/or modified CDS sequence (AUadapt) from InfluenzaA__AIL93850__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgaggccugcaaccaguccgucaucacguacgagaacaacaccugggugaaccagaccuacgugaacaucagcaacaccaacuucgcgacgggccaguccgucgugagcgugaagcuggccgggaacuccucgcucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacucgcgguucgaguccguggccuggagcgcguccgccugccacgacgggaucaacuggcucaccaucggcaucagcggccccgacuccggggccgucgccgugcugaaguacaacggcaucaucaccgacaccaucaagagcuggaagaacaacauccugcgcacgcaggaguccgagugcgcgugcgugaacgggagcugcuucaccaucaugaccgacggcccguccgacggccaggccagcuacaagaucuuccggaucgagaaggggaagaucgucaaguccguggagaugaacgcccccaacuaccacuacgaggagugcucgugcuaccccgacuccagcgagaucacgugcgugugccgcgacaacuggcacggcuccaaccggcccugggucagcuucaaccagaaccucgaguaccagaucggguacaucugcuccggcguguucggggacaacccgcgccccaacgacaagaccggcagcugcggccccguguccagcaacggggccaagggcgucaagggguucagcuucaaguacggcaacgggguguggaucggccggaccaaguccaucucgucccgcaagggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 28050 - RNA, 1410 nt, Artificial Sequence; identical to SEQ ID NO: 28039
  derived and/or modified CDS sequence (AUadapt) from InfluenzaA__AIL93861__NA

SEQ ID NO: 28051 - RNA, 1410 nt, Artificial Sequence
  derived and/or modified CDS sequence (AUadapt) from InfluenzaA__AIL93885__NA
augaaccccaaccagaagaucaucaccaucggcucggugucccugaccaucucgacgaucugcuucuucaugcagaucgccauccucaucaccaccgucacccugcacuucaagcaguacgaguucgacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucgggggucuucuccguggagggcaagagcugcaucaaccggugcuucuacguggagcugauccgcggccggaaggaggagaccgagguccucuggaccucgaacuccaucgugguguucugcgggacgagcggcaccuacgggaccggcuccuggcccgacggggccgaccugaaccugaugcccaucuga

SEQ ID NO: 28052 - RNA, 1410 nt, Artificial Sequence; identical to SEQ ID NO: 28039
  derived and/or modified CDS sequence (AUadapt) from InfluenzaA__AIL93897__NA

SEQ ID NO: 28053 - RNA, 1410 nt, Artificial Sequence
  derived and/or modified CDS sequence (AUadapt) from InfluenzaA__AIL93909__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcucgaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacuccggggccguggccguccugaaguacaacggcaucaucaccgacaccaucaagucguggcgcaacaacauccugcggacgcaggaguccgagugcgugugcgugaacgggagcugcuucaccaucaugaccgacggcccguccgacggccaggcgagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucagcuucaaguacggcaacggggucuggaucggccgcaccaaguccaucagcucccggaagggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 28054 - RNA, 1410 nt, Artificial Sequence; identical to SEQ ID NO: 28039
  derived and/or modified CDS sequence (AUadapt) from InfluenzaA__AIL93920__NA

SEQ ID NO: 28055 - RNA, 1410 nt, Artificial Sequence
  derived and/or modified CDS sequence (AUadapt) from InfluenzaA__AIL93943__NA
augaaccccaaccagaagaucaucaccaucggcucggugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccucgcucugcccgguguccggcugggccaucuacagcaaggacaacuccgugcgcaucggcagcaagggggacgucuucgugauccgggagcccuucaucuccugcagccccuccgagugccgcaccuucuuccugacccagggcgcccugcucaacgacaagcacagcaacgggaccaucaaggaccggucccccuaccgcacgcugaugucgugcccgaucggcgaggugcccagccccuacaacucccgguucgagagcgucgccugguccgcgagcgccugccacgacgggaucaacuggcugaccaucggcaucuccggccccgacagcggggccguggccgugcucaaguacaacggcaucaucaccgacaccaucaaguccuggcgcaacaacauccugcggacgcaggagucggagugcgcgugcgucaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccuggaguaccagaucggguacaucugcucgggcguguucggggacaacccgcggcccaacgacaagaccggcuccugcggccccgucagcagcaacggggccaacggcgugaagggguucuccuucaaguacggcaacgggguguggaucggccgcaccaagagcaucuccagccggaagggcuucgagaugaucugggaccccaacggguggaccggcaccgacaacaacuucuccaucaagcaggacaucgucgggaucaaggaguggucgggcuacuccgggagcuucgugcagcacccggagcucacgggccuggacugcauccgccccugcuucugggucgagcugauccggggccgccccgaggagaacaccaucuggaccuccgggagcuccaucagcuucugcggcgugaacuccgacaccgugggguggagcuggcccgacggcgccgagcucccguucacgaucgacaaguga

SEQ ID NO: 28056 - RNA, 1410 nt, Artificial Sequence; identical to SEQ ID NO: 28039
  derived and/or modified CDS sequence (AUadapt) from InfluenzaA__AIL93954__NA

SEQ ID NO: 28057 - RNA, 1410 nt, Artificial Sequence; identical to SEQ ID NO: 28039
  derived and/or modified CDS sequence (AUadapt) from InfluenzaA__AIL93966__NA

SEQ ID NO: 28058 - RNA, 1410 nt, Artificial Sequence
  derived and/or modified CDS sequence (AUadapt) from InfluenzaA__AIL93978__NA
augaaccccaaccagaagaucaucaccaucggcucggugucccugaccaucucgacgaucugccucuucaugcagaucgccauccugaucaccaccgucacccugcacuucaagcaguacgaguucaacuccccgcccaacaaccaggugaugcucugcgagcccacgaucaucgagcgcaacaucaccgagaucguguaccugaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccucgggcagggcaccacgcugaacaacgugcacuccaacaacaccguccgcgaccggacccccuaccgcacccugcucaugaacgagcugggcgugcccuuccaccuggggacgaagcaggucugcaucgccuggucguccucguccugccacgacggcaaggccuggcuccacgugugcaucaccggggacgacaagaacgcgaccgccagcuucaucuacaacggccggcugguggacuccguggucucgugguccaaggagauccugcgcacccaggagagcgagugcgugugcaucaacgggacgugcaccguggucaugaccgacggcuccgccucgggcaaggccgacaccaagauccucuucaucgaggaggggaagaucgugcacacgagcacccuguccggcucggcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacaccccgcggaagaacgacuccagcuccucgucccacugccucgaccccaacaacgaggagggcgggcacggcgucaaggggugggccuucgacgacggcaacgacguguggaugggccgcaccaucaacgagacgucgcggcugggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcucauccgcggccggaaggaggagaccgaggugcuguggaccucgaacuccaucgucguguucugcgggacgagcggcaccuacgggaccggcuccuggcccgacggggccgaccugaaccucaugcccaucuga

SEQ ID NO: 28059 - RNA, 1410 nt, Artificial Sequence; identical to SEQ ID NO: 28048
  derived and/or modified CDS sequence (AUadapt) from InfluenzaA__AIL93990__NA

SEQ ID NO: 28060 - RNA, 1410 nt, Artificial Sequence; identical to SEQ ID NO: 16339
  derived and/or modified CDS sequence (AUadapt) from InfluenzaA__AIL94001__NA

SEQ ID NO: 28061 - RNA, 1410 nt, Artificial Sequence; identical to SEQ ID NO: 28039
  derived and/or modified CDS sequence (AUadapt) from InfluenzaA__AIL94013__NA

SEQ ID NO: 28062 - RNA, 1410 nt, Artificial Sequence; identical to SEQ ID NO: 28039
  derived and/or modified CDS sequence (AUadapt) from InfluenzaA__AIL94025__NA

SEQ ID NO: 28063 - RNA, 1410 nt, Artificial Sequence; identical to SEQ ID NO: 28039
  derived and/or modified CDS sequence (AUadapt) from InfluenzaA__AIL94037__NA

SEQ ID NO: 28064 - RNA, 1410 nt, Artificial Sequence; identical to SEQ ID NO: 28039
  derived and/or modified CDS sequence (AUadapt) from InfluenzaA__AIL94049__NA

SEQ ID NO: 28065 - RNA, 1410 nt, Artificial Sequence; identical to SEQ ID NO: 28048
  derived and/or modified CDS sequence (AUadapt) from InfluenzaA__AIL94061__NA

SEQ ID NO: 28066 - RNA, 1410 nt, Artificial Sequence
  derived and/or modified CDS sequence (AUadapt) from InfluenzaA__AIL94072__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgaggccugcaaccaguccgucaucacguacgagaacaacaccugggugaaccagaccuacgugaacaucagcaacaccaacuucgcgacgggccaguccgucgugagcgugaagcuggccgggaacuccucgcucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacucgcgguucgaguccguggccuggagcgcguccgccugccacgacgggaucaacuggcucaccaucggcaucagcggccccgacuccggggccgucgccgugcugaaguacaacggcaucaucaccgacaccaucaagagcuggaagaacaacauccugcgcacgcaggaguccgagugcgcgugcgugaacgggagcugcuucaccaucaugaccgacggcccguccgacggccaggccagcuacaagaucuuccggaucgagaaggggaagaucgucaaguccguggagaugaacgcccccaacuaccacuacgaggagugcucgugcuaccccgacuccagcgagaucacgugcgugugccgcgacaacuggcacggcuccaaccggcccugggucagcuucaaccagaaccucgaguaccagaucggguacaucugcuccggcguguucggggacaacccgcgccccaacgacaagaccggcagcugcggccccgugcuguccaacggggccaacggcgucaagggguucagcuucaaguacggcaacgggguguggaucggccggaccaagagcaucuccucgcgcaagggcuucgagaugaucugggaccccaacggguggaccggcaccgacaacaacuucuccaucaagcaggacaucguggggaucaacgaguggagcggcuacuccgggagcuucguccagcacccggagcugacgggccucgacugcauccggcccugcuucuggaucgagcugauccgcggccggcccaaggagaacaccaucuggaccuccgggagcuccaucagcuucugcggcgugaacuccgacaccgucggguggagcuggcccgacggcgccgagcugccguucacgaucgacaaguga

SEQ ID NO: 28067 - RNA, 1410 nt, Artificial Sequence; identical to SEQ ID NO: 28048
  derived and/or modified CDS sequence (AUadapt) from InfluenzaA__AIL94083__NA

SEQ ID NO: 28068 - RNA, 1410 nt, Artificial Sequence; identical to SEQ ID NO: 28039
  derived and/or modified CDS sequence (AUadapt) from InfluenzaA__AIL94238__NA

SEQ ID NO: 28069 - RNA, 1410 nt, Artificial Sequence
  derived and/or modified CDS sequence (AUadapt) from InfluenzaA__AIL94250__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgaggccugcaaccaguccgucaucacguacgagaacaacaccugggugaaccagaccuacgugaacaucagcaacaccaacuucgcggccggccaguccgucgugucggugaagcuggccgggaacuccagccucugcccggucuccggcugggccaucuacagcaaggacaacuccgugcgcaucggcagcaagggggacguguucgucauccgggagcccuucaucuccugcagcccccuggagugccgcacguucuuccugacccagggcgcccuccugaacgacaagcacuccaacgggaccaucaaggaccggucgcccuaccgcacccugauguccugcccgaucggcgaggugcccagccccuacaacagccgguucgaguccguggcguggagcgccuccgccugccacgacgggaucaacuggcucacgaucggcaucagcggccccgacuccggggccgucgcggugcugaaguacaacggcaucaucaccgacaccaucaagucguggaagaacaacauccugcgcacccaggaguccgagugcgccugcgugaacgggagcugcuucacgaucaugaccgacggcccgaacgacggccaggccuccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcagcaaccggcccugggucuccuucaaccagaaccucgaguaccagaucggguacaucugcucgggcguguucggggacaacccgcgccccaacgacaagaccggcuccugcggccccgugagcuccaacggggccaacggcgucaagggguucagcuucaaguacggcaacgggguguggaucggccggaccaagagcaucuccagccgcaagggcuucgagaugaucugggaccccaacggguggaccggcaccgacaacaacuucuccaucaagcaggacaucguggggaucaacgaguggucgggcuacuccgggagcuucguccagcacccggagcugaccggccuggacugcauccggcccugcuucuggguggagcucauccgcggccggcccaaggagaacacgaucuggaccuccgggagcuccaucagcuucugcggcgucaacuccgacaccgugggguggagcuggcccgacggcgcggagcugccguucaccaucgacaaguga

SEQ ID NO: 28070 - RNA, 1410 nt, Artificial Sequence; identical to SEQ ID NO: 16339
  derived and/or modified CDS sequence (AUadapt) from InfluenzaA__AIL94261__NA

SEQ ID NO: 28071 - RNA, 1410 nt, Artificial Sequence; identical to SEQ ID NO: 16339
  derived and/or modified CDS sequence (AUadapt) from InfluenzaA__AIL94273__NA

SEQ ID NO: 28072 - RNA, 1410 nt, Artificial Sequence; identical to SEQ ID NO: 16339
  derived and/or modified CDS sequence (AUadapt) from InfluenzaA__AIL94285__NA

SEQ ID NO: 28073 - RNA, 1410 nt, Artificial Sequence
  derived and/or modified CDS sequence (AUadapt) from InfluenzaA__AIL94297__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggagauccugcgcacccaggagagcgagugcgugugcaucaacgggacgugcaccguggucaugaccgacggcuccgccucgggcaaggccgacaccaagauccuguucaucgaggaggggaagaucgugcacacgcggacccucagcggcuccgcgcagcacguggaggagugcucgugcuacccccgcuacccggggguccggugcgugugccgcgacaacuggaagggcuccaaccggcccaucguggacaucaacaucaaggaccacucgaucgucuccagcuacgugugcuccggccuggugggggacacgccccgcaagaacgacucguccagcuccucgcacugccuggaccccaacaacgaggagggcgggcacggcgucaaggggugggccuucgacgacggcaacgacguguggaugggccggaccaucaacgagaccucccgccucggguacgagaccuucaaggucaucgagggcuggucgaacccgaaguccaagcugcagaucaacaagcaggucaucguggaccgcggggaccggagcggcuacuccgggaucuucucgguggagggcaaguccugcaucaaccggugcuucuacguggagcugauccgcggccggaaggaggagaccgaggugcucuggaccagcaacucgaucgucguguucugcgggacguccggcaccuacgggaccggcagcuggcccgacggggccgaccugaaccugaugcccaucuga

SEQ ID NO: 28074 - RNA, 1410 nt, Artificial Sequence; identical to SEQ ID NO: 28039
  derived and/or modified CDS sequence (AUadapt) from InfluenzaA__AIL94309__NA

SEQ ID NO: 28075 - RNA, 1410 nt, Artificial Sequence; identical to SEQ ID NO: 28058
  derived and/or modified CDS sequence (AUadapt) from InfluenzaA__AIL94321__NA

SEQ ID NO: 28076 - RNA, 1410 nt, Artificial Sequence; identical to SEQ ID NO: 16339
  derived and/or modified CDS sequence (AUadapt) from InfluenzaA__AIL94368__NA

SEQ ID NO: 28077 - RNA, 1410 nt, Artificial Sequence
  derived and/or modified CDS sequence (AUadapt) from InfluenzaA__AIL94380__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccguggucgacaucaacaucaaggaccacuccaucgugucguccuacgugugcagcggccuggucggggacaccccgcggaagaacgacuccucguccagcucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaucaacaagcaggucaucguggaccgcggggaccgguccggcuacucggggaucuucuccguggagggcaagagcugcaucaaccgcugcuucuacguggagcugauccggggccgcaaggaggagaccgagguccucuggaccucgaacuccaucgugguguucugcgggacgagcggcaccuacgggaccggcuccuggcccgacggggccgaccugaaccugaugcccaucuga

SEQ ID NO: 28078 - RNA, 1410 nt, Artificial Sequence
  derived and/or modified CDS sequence (AUadapt) from InfluenzaA__AIL94392__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgaggccugcaaccaguccgucaucacguacgagaacaacaccugggugaaccagaccuacgugaacaucagcaacaccaacuucgcggccggccaguccgucgugagcgugaagcuggccgggaacuccucgcucugcccggucuccggcugggccaucuacagcaaggacaacuccgugcgcaucggcagcaagggggacguguucgucauccgggagcccuucaucuccugcagcccccuggagugccgcacguucuuccugacccagggcgcccuccugaacgacaagcacuccaacgggaccaucaaggaccggagccccuaccgcacccugauguccugcccgaucggcgaggugcccagccccuacaacucgcgguucgaguccguggcguggagcgccuccgccugccacgacgggaucaacuggcucacgaucggcaucagcggccccgacuccggggccgucgcggugcugaaguacaacggcaucaucaccgacaccaucaagagcuggaagaacaacauccugcgcacccaggaguccgagugcgccugcgugaacgggagcugcuucacgaucaugaccgacggcccguccgacggccaggccagcuacaagaucuuccggaucgagaaggggaagaucgucaaguccguggagaugaacgcccccaacuaccacuacgaggagugcucgugcuaccccgacuccagcgagaucacgugcgugugccgcgacaacuggcacggcuccaaccggcccugggucagcuucaaccagaaccucgaguaccagaucggguacaucugcuccggcguguucggggacaacccgcgccccaacgacaagaccggcagcugcggccccguguccagcaacggggccaacggcgucaagggguucagcuucaaguacggcaacgggguguggaucggccggaccaaguccaucucgucccgcaagggcuucgagaugaucugggaccccaacggguggaccggcaccgacaacaacuucagcaucaagcaggacaucguggggaucaacgagugguccggcuacagcggguccuucguccagcacccggagcugaccggccuggacugcauccggcccugcuucuggguggagcucauccgcggccggcccaaggagaacacgaucuggaccagcggguccagcaucuccuucugcggcgucaacagcgacaccguggggugguccuggcccgacggcgcggagcugccguucaccaucgacaaguga

SEQ ID NO: 28079 - RNA, 1410 nt, Artificial Sequence
  derived and/or modified CDS sequence (AUadapt) from InfluenzaA__AIL94403__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgaggccugcaaccaguccgucaucacguacgagaacaacaccugggugaaccagaccuacgugaacaucagcaacaccaacuucgcggccggccaguccgucgugagcgugaagcuggccgggaacuccucgcucugcccggucuccggcugggccaucuacagcaaggacaacuccgugcgcaucggcagcaagggggacguguucgucauccgggagcccuucaucuccugcagcccccuggagugccgcacguucuuccugacccagggcgcccuccugaacgacaagcacuccaacgggaccaucaaggaccggagccccuaccgcacccugauguccugcccgaucggcgaggugcccagccccuacaacucgcgguucgaguccguggcguggagcgccuccgccugccacgacgggaucaacuggcucacgaucggcaucagcggccccgacuccggggccgucgcggugcugaaguacaacggcaucaucaccgacaccaucaagagcuggaagaacaacauccugcgcacccaggaguccgagugcgccugcgugaacgggagcugcuucacgaucaugaccgacggcccguccgacggccaggccagcuacaagaucuuccggaucgagaaggggaagaucgucaaguccguggagaugaacgcccccaacuaccacuacgaggagugcucgugcuaccccgacuccagcgagaucacgugcgugugccgcgacaacuggcacggcuccaaccggcccugggucagcuucaaccagaaccucgaguaccagaucggguacaucugcuccggcguguucggggacaacccgcgccccaacgacaagaccggcagcugcgaccccguguccagcaacggcgccaacggggucaagggcuucagcuucaaguacgggaacggcguguggaucgggcggaccaaguccaucucgucccgcaagggcuucgagaugaucugggaccccaacggcuggaccgggaccgacaacaacuucagcaucaagcaggacaucgugggcaucaacgagugguccggguacagcggcuccuucguccagcacccggagcugaccgggcuggacugcauccggcccugcuucuggguggagcucauccgcggccggcccaaggagaacacgaucuggaccagcggcuccagcaucuccuucugcggggucaacagcgacaccgugggcugguccuggcccgacggggcggagcugccguucaccaucgacaaguga

SEQ ID NO: 28080 - RNA, 1410 nt, Artificial Sequence; identical to SEQ ID NO: 16339
  derived and/or modified CDS sequence (AUadapt) from InfluenzaA__AIL94426__NA

SEQ ID NO: 28081 - RNA, 1410 nt, Artificial Sequence
  derived and/or modified CDS sequence (AUadapt) from InfluenzaA__AIL94438__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgaggccugcaaccaguccgucaucacguacgagaacaacaccugggugaaccagaccuacgugaacaucagcaacaccaacuucgcgacgggccaguccgucgugagcgugaagcuggccgggaacuccucgcucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacucgcgguucgaguccguggccuggagcgcguccgccugccacgacgggaucaacuggcucaccaucggcaucagcggccccgacuccggggccgucgccgugcugaaguacaacggcaucaucaccgacaccaucaagagcuggaagaacaacauccugcgcacgcaggaguccgagugcgcgugcgugaacgggagcugcuucaccaucaugaccgacggcccguccgacggccaggccagcuacaagaucuuccggaucgagaaggggaagaucgucaaguccguggagaugaacgcccccaacuaccacuacgaggagugcucgugcuaccccgacuccagcgagaucacgugcgugugccgcgacaacuggcacggcuccaaccggcccugggucagcuucaaccagaaccucgaguaccagaucggguacaucugcuccggcguguucggggacaacccgcgccccaacgacaagaccggcagcugcggccccguguccagcaacggggccaacggcgucaagggguucagcuucaaguacggcaacgggguguggaucggccggaccaaguccgugucgucccgcaagggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccguggggugguccuggcccgacggcgccgagcugccguucacgaucgacaaguga

SEQ ID NO: 28082 - RNA, 1410 nt, Artificial Sequence
  derived and/or modified CDS sequence (AUadapt) from InfluenzaA__AIL94449__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccaaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucuacucguacgugugcuccggccuggugggggacacgccccggaagaacgacagcuccucguccagccacugccugaaccccaacaacgaggagggcgggcacggcgucaaggggugggccuucgacgacggcaacgacguguggaugggccgcaccaucaacgagaccucccggcucggguacgagaccuucaaggucaucgagggcuggucgaacccgaaguccaagcugcagaucaaccgccaggugaucguggaccgcggggaccggagcggcuacuccgggaucuucucggucgagggcaaguccugcaucaaccggugcuucuacguggagcugauccgcggccggaaggaggagaccgaggugcucuggaccagcaacucgaucgucguguucugcgggacguccggcaccuacgggaccggcagcuggcccgacggggccgaccugaaccugaugcccaucuga

SEQ ID NO: 28083 - RNA, 1410 nt, Artificial Sequence; identical to SEQ ID NO: 28077
  derived and/or modified CDS sequence (AUadapt) from InfluenzaA__AIL94461__NA

SEQ ID NO: 28084 - RNA, 1410 nt, Artificial Sequence
  derived and/or modified CDS sequence (AUadapt) from InfluenzaA__AIL94473__NA
augaaccccaaccagaagaucaucaccaucggcucggugugcaugaccaucgggauggccaaccugauccuccagaucggcaacaucaucuccaucugggucgggcacagcauccagcugggcaaccagucccagaucgagacgugcaaccagagcgugaucaccuacgagaacaacaccugggugaaccagaccuacgucaacaucuccaacacgaacuucgccgcggggcagagcguggugccggucaagcuggccggcaacuccagccucugccccguguccggcugggccaucuacucgaaggacaacuccgugcgcaucgggagcaagggcgacgucuucgugauccgggagcccuucaucuccugcagcccccuggagugccgcaccuucuuccugacccagggggcccuccugaacgacaagcacuccaacggcaccaucaaggaccggagcccguaccgcacgcugauguccugccccaucggggaggugcccagccccuacaacucccgguucgagagcgucgccuggucggcguccgccugccacgacggcaucaacuggcucaccaucggcaucagcgggccggacuccggcgccguggccgugcugaaguacaacgggaucaucaccgacaccaucaagagcuggcgcaacaacauccugcggacgcaggaguccgagugcgcgugcgucaacggcagcugcuucaccaucaugaccgacggccccuccgacgggcaggccagcuacaagaucuuccgcaucgagaagggcaagaucgugaaguccguggagaugaacacccccaacuaccacuacgaggagugcucgugcuaccccgacuccagcgagaucacgugcgucugccgggacaacuggcacggguccaaccgcccgugggugagcuucaaccagaaccucgaguaccagaucggcuacaucugcuccgggguguucggcgacaacccccggcccaacgacaagaccggcagcugcgggcccgucuccagcaacggcgccaacggggugaagggcuucuccuucaaguacgggaacggcguguggaucggccgcaccaagagcaucucgucccggaagggguucgagaugaucugggacccgaacggcuggaccgggacggacaacaacuucagcaucaagcaggacaucgucggcaucaaggagugguccggguacagcggcuccuucgugcagcaccccgagcugaccggccuggacugcauccgccccugcuucugggucgagcucauccgggggcgccccgaggagaacaccaucuggaccagcggcuccagcaucuccuucugcggggugaacagcgacaucgugggcugguccuggccggacggcgccgagcugcccuucacgaucgacaaguga

SEQ ID NO: 28085 - RNA, 1410 nt, Artificial Sequence; identical to SEQ ID NO: 27138
  derived and/or modified CDS sequence (AUadapt) from InfluenzaA__AIL94484__NA

SEQ ID NO: 28086 - RNA, 1410 nt, Artificial Sequence; identical to SEQ ID NO: 28048
  derived and/or modified CDS sequence (AUadapt) from InfluenzaA__AIL94507__NA

SEQ ID NO: 28087 - RNA, 1410 nt, Artificial Sequence
  derived and/or modified CDS sequence (AUadapt) from InfluenzaA__AIL94518__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcagcgcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacaccccgcggaagaacgacuccagcuccucgucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagucgaagcugcagaucaacaagcaggucaucguggaccgcggggaccgguccggcuacagcgggaucuucuccguggagggcaagucgugcaucaaccgcugcuucuacguggagcugauccggggccgcaaggaggagaccgaggugcucuggaccagcaacuccaucgucguguucugcgggacgucgggcaccuacgggaccggcuccuggcccgacggggccgaccugagccugaugcccaucuga

SEQ ID NO: 28088 - RNA, 1410 nt, Artificial Sequence
  derived and/or modified CDS sequence (AUadapt) from InfluenzaA__AIL94530__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccugaaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 28089 - RNA, 1410 nt, Artificial Sequence; identical to SEQ ID NO: 28078
  derived and/or modified CDS sequence (AUadapt) from InfluenzaA__AIL94542__NA

SEQ ID NO: 28090 - RNA, 1410 nt, Artificial Sequence; identical to SEQ ID NO: 28048
  derived and/or modified CDS sequence (AUadapt) from InfluenzaA__AIL94553__NA

SEQ ID NO: 28091 - RNA, 1410 nt, Artificial Sequence; identical to SEQ ID NO: 28039
  derived and/or modified CDS sequence (AUadapt) from InfluenzaA__AIL94564__NA

SEQ ID NO: 28092 - RNA, 1410 nt, Artificial Sequence; identical to SEQ ID NO: 28048
  derived and/or modified CDS sequence (AUadapt) from InfluenzaA__AIL94576__NA

SEQ ID NO: 28093 - RNA, 1410 nt, Artificial Sequence
  derived and/or modified CDS sequence (AUadapt) from InfluenzaA__AIL94587__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgaggccugcaaccaguccgucaucacguacgagaacaacaccugggugaaccagaccuacgugaacaucagcaacaccaacuucgcggccggccaguccgucgugucggugaagcuggccgggaacuccagccucugcccggucuccggcugggccaucuacagcaaggacaacuccgugcgcaucggcagcaagggggacguguucgucauccgggagcccuucaucuccugcagcccccuggagugccgcacguucuuccugacccagggcgcccuccugaacgacaagcacuccaacgggaccaucaaggaccggucgcccuaccgcacccugauguccugcccgaucggcgaggugcccagccccuacaacagccgguucgaguccguggcguggagcgccuccgccugccacgacgggaucaacuggcucacgaucggcaucagcggccccgacuccggggccgucgcggugcugaaguacaacggcaucaucaccgacaccaucaagucguggaagaacaacauccugcgcacccaggaguccgagugcgccugcgugaacgggagcugcuucacgaucaugaccgacggcccguccgacggccaggccagcuacaagaucuuccggaucgagaaggggaagaucgucaaguccguggagauggacgcccccaacuaccacuacgaggagugcagcugcuaccccgacuccagcgagaucacgugcgugugccgcgacaacuggcacggcuccaaccggcccugggucucguucaaccagaaccucgaguaccagaucggguacaucugcuccggcguguucggggacaacccgcgccccaacgacaagaccggcagcugcggccccguguccagcaacggggccaacggcgucaagggguucagcuucaaguacggcaacgggguguggaucggccggacgaaguccaucagcucccgcaagggcuucgagaugaucugggaccccaacggguggaacggcaccgacaacaacuucucgaucaagcaggacaucguggggaucaacgagugguccggcuacagcggguccuucguccagcacccggagcugaccggccuggacugcauccggcccugcuucuggguggagcucauccgcggccggcccaaggagaacaccaucuggaccgggggcagcuccaucagcuucugcggggucaacuccgacaccgugggcuggagcuggcccgacggcgcggagcugccguucaccaucgacaaguga

SEQ ID NO: 28094 - RNA, 1410 nt, Artificial Sequence; identical to SEQ ID NO: 28078
  derived and/or modified CDS sequence (AUadapt) from InfluenzaA__AIL94598__NA

SEQ ID NO: 28095 - RNA, 1410 nt, Artificial Sequence
  derived and/or modified CDS sequence (AUadapt) from InfluenzaA__AIL94609__NA
augaaccccaaccagaagaucaucaccaucggcucggugucccugaccaucucgacgaucugccucuucaugcagaucgccauccugaucaccaccgucacccugcacuucaagcaguacgaguucaacuccccgcccaacaaccaggugaugcucugcgagcccacgaucaucgagcgcaacaucaccgagaucguguaccugaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccucgggcagggcaccacgcugaacaacgugcacuccaacaacaccguccgcgaccggacccccuaccgcacccugcucaugucggagcugggcgugcccuuccaccuggggacgaagcaggucugcaucgccugguccagcuccucgugccacgacggcaaggccuggcuccacgugugcaucaccggggacgacaagaacgcgaccgccuccuucaucuacaacggccggcugguggacagcguggucuccuggucgaaggagauccugcgcacccaggaguccgagugcgugugcaucaacgggacgugcaccguggucaugaccgacggcagcgccucgggcaaggccgacaccaagauccucuucaucgaggaggggaagaucgugcacacguccacccugagcggcuccgcgcagcacguggaggagugcucgugcuacccccuguacccggggguccggugcgugugccgcgacaacuggaagggcuccaaccggcccaucguggacaucaacaucaaggaccacagcaucgucuccucguacgugugcuccggccucgugggggacacgccccgcaagaacgacagcuccucguccagccacugccuggaccccaacaacgaggagggcgggcacggcgucaaggggugggccuucgacgacggcaacgacguguggaugggccggaccaucaacgagaccucccgccugggguacgagaccuucaaggucaucgagggcuggucgaacccgaaguccaagcuccagaucaaccggcaggucaucguggaccgcggggaccggagcggcuacuccgggaucuucucgguggagggcaagagcugcaucaaccgcugcuucuacguggagcugauccggggccgcaaggaggagaccgaggugcuguggaccuccaacucgaucgucguguucugcgggacguccggcaccuacgggaccggcagcuggcccgacggggccgaccucaaccugaugcccaucuga

SEQ ID NO: 28096 - RNA, 1410 nt, Artificial Sequence
  derived and/or modified CDS sequence (AUadapt) from InfluenzaA__AIL94621__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgaggccugcaaccaguccgucaucacguacgagaacaacaccugggugaaccagaccuacgugaacaucagcaacaccaacuucgcggccggccaguccgucgugccggugaagcuggccgggaacucgucccucugccccgucagcggcugggccaucuacuccaaggacaacagcgugcgcaucggcuccaagggggacguguucgucauccgggagcccuucaucagcugcagcccccuggagugccgcacguucuuccugacccagggcgcccuccugaacgacaagcacuccaacgggaccaucaaggaccgguccccguaccgcacccugaugucgugccccaucggcgaggugcccucccccuacaacagccgguucgagagcguggcgugguccgccagcgccugccacgacgggaucaacuggcucacgaucggcaucuccggcccggacagcggggccgucgcggugcugaaguacaacggcaucaucaccgacaccaucaaguccuggaagaacaacauccugcgcacccaggagucggagugcgccugcgugaacggguccugcuucacgaucaugaccgacggccccagcgacggccaggccuccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcagcaaccggccgugggucuccuucaaccagaaccucgaguaccagaucggguacaucugcucgggcguguucggggacaacccccgccccaacgacaagaccggcuccugcggccccgugagcuccaacggggccaacggcgucaagggguucagcuucaaguacggcaacgggguguggaucggccggaccaagagcaucuccagccgcaagggcuucgagaugaucugggacccgaacggguggaccggcaccgacaacgacuucuccaucaagcaggacaucguggggaucaacgaguggucgggcuacuccgggagcuucguccagcaccccgagcugaccggccuggacugcauccggcccugcuucuggguggagcucauccgcggccggcccaaggagaacacgaucuggaccuccgggagcuccaucagcuucugcggcgucaacuccgacaccgugggguggagcuggccggacggcgcggagcugcccuucaccaucgacaaguga

SEQ ID NO: 28097 - RNA, 1410 nt, Artificial Sequence; identical to SEQ ID NO: 28048
  derived and/or modified CDS sequence (AUadapt) from InfluenzaA__AIL94632__NA

SEQ ID NO: 28098 - RNA, 1410 nt, Artificial Sequence; identical to SEQ ID NO: 16339
  derived and/or modified CDS sequence (AUadapt) from InfluenzaA__AIL94643__NA

SEQ ID NO: 28099 - RNA, 1410 nt, Artificial Sequence
  derived and/or modified CDS sequence (AUadapt) from InfluenzaA__AIL94655__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucgcgguucgaguccguggccuggagcgcguccgccugccacgacgggaucaacuggcucaccaucggcaucagcggccccgacuccggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucagcuucaaguacggcaacgggguguggaucggccgcaccaaguccaucucgucccggaagggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 28100 - RNA, 1410 nt, Artificial Sequence
  derived and/or modified CDS sequence (AUadapt) from InfluenzaA__AIL94677__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgaggccugcaaccaguccgucaucacguacgagaacaacaccugggugaaccagaccuacgugaacaucagcaacaccaacuucgcggccggccaguccgucgugccggugaagcuggccgggaacucgucccucugccccgucagcggcugggccaucuacuccaaggacaacagcgugcgcaucggcuccaagggggacguguucgucauccgggagcccuucaucagcugcagcccccuggagugccgcacguucuuccugacccagggcgcccuccugaacgacaagcacuccaacgggaccaucaaggaccgguccccguaccgcacccugaugucgugccccaucggcgaggugcccucccccuacaacagccgguucgagagcguggcgugguccgccagcgccugccacgacgggaucaacuggcucacgaucggcaucuccggcccggacagcggggccgucgcggugcugaaguacaacggcaucaucaccgacaccaucaaguccuggaagaacaacauccugcgcacccaggagucggagugcgccugcgugaacggguccugcuucacgaucaugaccgacggccccagcgacggccaggccuccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcagcaaccggccgugggucuccuucaaccagaaccucgaguaccagaucggguacaucugcucgggcguguucggggacaacccccgccccaacgacaagaccggcuccugcggccccgugagcuccaacggggccaacggcgucaagggguucagcuucaaguacggcaacgggguguggaucggccggaccaagagcaucuccagccgcaagggcuucgagaugaucugggacccgaacggguggaccggcaccgacaacaacuucuccaucaagcaggacaucguggggaucaacgaguggucgggcuacuccgggagcuucguccagcaccccgagcugaccggccuggacugcauccggcccugcuucuggguggagcucauccgcggccggcccaaggagaacacgaucuggaccuccgggagcuccaucagcuucugcggcgucaacuccgacaccgugggguggagcuggccggacggcgcggagcugcccuucaccaucgacaaguga

SEQ ID NO: 28101 - RNA, 1410 nt, Artificial Sequence; identical to SEQ ID NO: 28039
  derived and/or modified CDS sequence (AUadapt) from InfluenzaA__AIL94688__NA

SEQ ID NO: 28102 - RNA, 1410 nt, Artificial Sequence
  derived and/or modified CDS sequence (AUadapt) from InfluenzaA__AIL94700__NA
augaaccccaaccagaagaucaucaccaucggcucggugucccugaccaucagcacgaucugcuucuucaugcagaucgccauccucaucaccaucgucacccugcacuucaagcaguacgaguucaacuccccgcccaacaaccaggugaugcugugcgagcccaccaucaucgagcgcaacaucacggagaucguguaccucaccaacaccaccaucgagaaggagaucugccccaagccggccgaguaccggaacuggucgaagccccagugcgggaucacgggcuucgcgcccuucuccaaggacaacagcauccgccuguccgccgggggcgacaucugggucacccgggagcccuacgugucgugcgacccggacaagugcuaccaguucgcccuggggcagggcaccacccucaacaacgugcacuccaacaacacgguccgcgaccggacccccuaccgcacccugcugaugaacgagcucggcgugcccuuccaccuggggaccaagcaggucugcaucgccuggagcuccucguccugccacgacggcaaggccuggcugcacgugugcaucacgggggacgacaagaacgcgaccgccagcuucaucuacaacggccggcucguggacuccguggucucgugguccaaggagauccugcgcacccaggagagcgagugcgugugcaucaacgggaccugcacgguggucaugaccgacggcuccgccucgggcaaggccgacaccaagauccuguucaucgaggaggggaagaucgugcacaucagcacccucuccggcagcgcgcagcacguggaggagugcuccugcuacccccgguacccggggguccgcugcgugugccgggacaacuggaagggcucgaaccgccccaucguggacaucaacaucgaggaccacuccaucgucagcuccuacgugugcucgggccuggugggggacacgccccggaagaacgacuccagcuccucgucccacugccuggaccccaacaacgaggagggcgggcacggcgucaaggggugggccuucgacgacggcaacgacguguggaugggccgcaccaucaacgagaccagccggcucggguacgagaccuucaaggucaucgagggcugguccaaccccaagucgaagcugcagaucaaccgccaggugaucguggaccgcggggaccgguccggcuacagcgggaucuucuccgucgagggcaagucgugcaucaaccggugcuucuacguggagcugauccgcggccggaaggaggagacggaggugcucuggaccagcaacuccaucgucguguucugcgggaccagcggcaccuacgggacgggcuccuggccggacggggccgaccugaaccugaugcccaucuga

SEQ ID NO: 28103 - RNA, 1410 nt, Artificial Sequence; identical to SEQ ID NO: 28048
  derived and/or modified CDS sequence (AUadapt) from InfluenzaA__AIL94712__NA

SEQ ID NO: 28104 - RNA, 1410 nt, Artificial Sequence; identical to SEQ ID NO: 28078
  derived and/or modified CDS sequence (AUadapt) from InfluenzaA__AIL94723__NA

SEQ ID NO: 28105 - RNA, 1410 nt, Artificial Sequence
  derived and/or modified CDS sequence (AUadapt) from InfluenzaA__AIL94734__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgagcacuccaacaacaccgugcgcgaccggacccccuaccgcacccugcugaugaacgagcucggcguccccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggugagcugguccaaggagauccugcgcacccaggagucggagugcgucugcaucaacgggacgugcaccguggugaugaccgacggcuccgccagcggcaaggccgacaccaagauccuguucaucgaggaggggaagaucguccacaucucgacgcucuccggcucggcgcagcacguggaggagugcuccugcuacccccgguacccgggggugcgcugcgucugccgggacaacuggaagggcagcaaccgccccaucguggacaucaacaucaaggaccacuccaucgugucguccuacgucugcagcggccuggugggggacaccccgcggaagaacgacuccucguccagcucccacugccuggaccccaacaacgaggagggcgggcacggcgugaaggggugggccuucgacgacggcaacgacgucuggaugggccgcaccaucaacgagaccucgcggcucggguacgagacguucaaggugaucgagggcugguccaaccccaagagcaagcugcagaucaaccgccaggucaucguggaccgcggggaccgguccggcuacucggggaucuucuccguggagggcaagagcugcaucaaccggugcuucuacgucgagcugauccgcggccggaaggaggagaccgaggugcucuggaccucgaacuccaucguggucuucugcgggaccagcggcacguacgggaccggcuccuggcccgacggggccgaccugaaccugaugcccaucuga

SEQ ID NO: 28106 - RNA, 1410 nt, Artificial Sequence; identical to SEQ ID NO: 28048
  derived and/or modified CDS sequence (AUadapt) from InfluenzaA__AIL94746__NA

SEQ ID NO: 28107 - RNA, 1410 nt, Artificial Sequence; identical to SEQ ID NO: 28078
  derived and/or modified CDS sequence (AUadapt) from InfluenzaA__AIL94757__NA

SEQ ID NO: 28108 - RNA, 1410 nt, Artificial Sequence; identical to SEQ ID NO: 28039
  derived and/or modified CDS sequence (AUadapt) from InfluenzaA__AIL94768__NA

SEQ ID NO: 28109 - RNA, 1410 nt, Artificial Sequence; identical to SEQ ID NO: 16339
  derived and/or modified CDS sequence (AUadapt) from InfluenzaA__AIL94780__NA

SEQ ID NO: 28110 - RNA, 1410 nt, Artificial Sequence; identical to SEQ ID NO: 28078
  derived and/or modified CDS sequence (AUadapt) from InfluenzaA__AIL94803__NA

SEQ ID NO: 28111 - RNA, 1410 nt, Artificial Sequence; identical to SEQ ID NO: 28058
  derived and/or modified CDS sequence (AUadapt) from InfluenzaA__AIL94814__NA

SEQ ID NO: 28112 - RNA, 1410 nt, Artificial Sequence
  derived and/or modified CDS sequence (AUadapt) from InfluenzaA__AIL94826__NA
augaaccccaaccagaagaucaucaccaucggcucggugucccugaccaucucgacgaucugcuucuucaugcagaucgccauccucaucaccaccgucacccugcacuucaagcaguacgaguucaacucccugccgaacaaccaggugaugcucugcgagcccacgaucaucgagcgcaacaucaccgagaucguguaccugaccaacaccacgaucgagaaggagaucugccccaagcccgccgaguaccggaacuggagcaagccgcagugcgggaucaccggcuucgcgcccuucuccaaggacaacucgauccgccuguccgccgggggcgacaucugggucacccgggagcccuacgugagcugcgaccccgacaagugcuaccaguucgcccucgggcagggcaccacgcugaacaacgugcacuccaacaacaccgcccgcgaccggaccccguaccgcacccugcucaugaacgagcugggcguccccuuccaccuggggacgaagcaggucugcaucgccuggucguccagcuccugccacgacggcaaggcguggcuccacgugugcaucaccggggacgacaagaacgccaccgccucguucaucuacaacggccggcugguggacuccguggugagcugguccaaggagauccugcgcacccaggagucggagugcgucugcaucaacgggacgugcaccguggugaugaccgacggcuccgccagcggcaaggcggacaccaagauccucuucaucgaggaggggaagaucguccacacgucgacccuguccggcucggcccagcacguggaggagugcuccugcuacccccgguaccccggggugcgcugcgucugccgggacaacuggaagggcagcaaccgcccgaucguggacaucaacaucaaggaccacuccaucgugucguccuacgucugcagcggccuggugggggacacgccccggaagaacgacuccucguccagcucccacugccucaaccccaacaacgaggagggcgggcacggcgugaaggggugggccuucgacgacggcaacgacgucuggaugggccgcaccaucaacgagaccucgcggcugggguacgagaccuucaaggugaucgagggcugguccaaccccaagagcaagcugcagaucaaccgccaggucaucguggaccgcggggaccgguccggcuacucggggaucuucuccguggagggcaagagcugcaucaaccggugcuucuacgucgagcucauccgcggccggaaggaggagaccgaggugcuguggaccucgaacuccaucguggucuucugcgggacgagcggcaccuacgggaccggcuccuggccggacggggccgaccugaaccucaugcccaucuga

SEQ ID NO: 28113 - RNA, 1410 nt, Artificial Sequence
  derived and/or modified CDS sequence (AUadapt) from InfluenzaA__AIL94850__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcuguucgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccagcggcaaggccgacaccaagauccucuucaucaaggagggcaagaucguccacacgucgacccuguccgggagcgcgcagcacguggaggagugcuccugcuacccccgguaccccggcgugcgcugcgucugccgggacaacuggaaggggucgaaccgcccgaucguggacaucaacaucaaggaccacuccaucgugagcuccuacgucugcagcggccuggugggcgacacgccccggaagaacgacuccucguccagcucccacugccucgaccccaacagcgaggagggcgggcacggggugaagggcugggccuucgacgacgggaacgacgucuggaugggccgcaccaucuccgagaagucccggcugggcuacgagaccuucaaggugaucgagggguggucgaaccccaagagcaaguuccagaucaaccgccaggucaucguggaccggggcaaccgcuccggguacagcggcaucuucucgguggaggggaaguccugcaucaaccggugcuucuacgucgagcugauccgcggccggaaggaggagaccgaggugcucuggaccagcaacuccaucguggucuucugcggcaccagcgggacguacggcaccggguccuggccggacggcgccgaccugaaccugaugcccaucuga

SEQ ID NO: 28114 - RNA, 1410 nt, Artificial Sequence; identical to SEQ ID NO: 21812
  derived and/or modified CDS sequence (AUadapt) from InfluenzaA__AIL94862__NA

SEQ ID NO: 28115 - RNA, 1410 nt, Artificial Sequence; identical to SEQ ID NO: 21812
  derived and/or modified CDS sequence (AUadapt) from InfluenzaA__AIL94874__NA

SEQ ID NO: 28116 - RNA, 1410 nt, Artificial Sequence
  derived and/or modified CDS sequence (AUadapt) from InfluenzaA__AIL94886__NA
augaaccccaaccagaagaucaucaccaucggcucggugugcaugaccaucgggauggccaaccugaugcuccagaucggcaacaucaucuccaucuggaucagccacuccauccagcuggggaacaagaaccagaucgagacgugcaaccagagcgucaucaccuacgagaacaacaccugggugaaccagaccuacgugaacaucuccaacacgaacuucgccgcgggccagagcgucguguccgugaagaucgccgggaacucgucccugugcccggucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcugaccaucggcaucuccggccccgacgacggggccguggccguccucaaguacaacggcaucaucaccgacaccaucaagagcuggcgcaacaacauccugcggacgcaggaguccgagugcgcgugcgugaacgggucgugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccuggaguaccagaucggguacaucugcuccggcaucuucggggacaacccgcggccccacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucucgaucaagcaggacaucgucgggaucaacgagugguccggcuacagcggguccuucgugcagcacccggagcucacgggccuggacugcauccgccccugcuucuggguggagcugauccggggccgccccaaggagaacaccaucuggaccagcggguccagcaucuccuucugcggcgucaacagcgacaccguggggugguccuggcccgacggcgccgagcucccguucacgaucgacaaguga

SEQ ID NO: 28117 - RNA, 1410 nt, Artificial Sequence; identical to SEQ ID NO: 25324
  derived and/or modified CDS sequence (AUadapt) from InfluenzaA__AIL94897__NA

SEQ ID NO: 28118 - RNA, 1410 nt, Artificial Sequence; identical to SEQ ID NO: 28112
  derived and/or modified CDS sequence (AUadapt) from InfluenzaA__AIL94909__NA

SEQ ID NO: 28119 - RNA, 1410 nt, Artificial Sequence; identical to SEQ ID NO: 16339
  derived and/or modified CDS sequence (AUadapt) from InfluenzaA__AIL94921__NA

SEQ ID NO: 28120 - RNA, 1410 nt, Artificial Sequence; identical to SEQ ID NO: 16339
  derived and/or modified CDS sequence (AUadapt) from InfluenzaA__AIL94933__NA

SEQ ID NO: 28121 - RNA, 1410 nt, Artificial Sequence; identical to SEQ ID NO: 28039
  derived and/or modified CDS sequence (AUadapt) from InfluenzaA__AIL94945__NA

SEQ ID NO: 28122 - RNA, 1410 nt, Artificial Sequence
  derived and/or modified CDS sequence (AUadapt) from InfluenzaA__AIL94957__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgaggccugcaaccaguccgucaucacguacgagaacaacaccugggugaaccagaccuacgugaacaucagcaacaccaacuucgcggccggccaguccgucgugagcgugaagcuggccgggaacuccucgcucugcccggucuccggcugggccaucuacagcaaggacaacuccgugcgcaucggcagcaagggggacguguucgucauccgggagcccuucaucuccugcagcccccuggagugccgcacguucuuccugacccagggcgcccuccugaacgacaagcacuccaacgggaccaucaaggaccggagccccuaccgcacccugauguccugcccgaucggcgaggugcccagccccuacaacucgcgguucgaguccguggcguggagcgccuccgccugccacgacgggaucaacuggcucacgaucggcaucagcggccccgacuccggggccgucgcggugcugaaguacaacggcaucaucaccgacaccaucaagagcuggaagaacaacauccugcgcacccaggaguccgagugcgccugcgugaacgggagcugcuucacgaucaugaccgacggcccguccgacggccaggccagcuacaagaucuuccggaucgagaaggggaagaucgucaaguccguggagauggacgcccccaacuaccacuacgaggagugcucgugcuaccccgacuccagcgagaucacgugcgugugccgcgacaacuggcacggcuccaaccggcccugggucagcuucaaccagaaccucgaguaccagaucggguacaucugcuccggcguguucggggacaacccgcgccccaacgacaagaccggcagcugcggccccguguccagcaacggggccaacggcgucaagggguucagcuucaaguacggcaacgggguguggaucggccggaccaaguccaucucgucccgcaagggcuucgagaugaucugggaccccaacggguggaacggcaccgacaacaacuucagcaucaagcaggacaucguggggaucaacgagugguccggcuacagcggguccuucguccagcacccggagcugaccggccuggacugcauccggcccugcuucuggguggagcucauccgcggccggcccaaggagaacaccaucuggacgagcggguccagcaucuccuucugcggcgucaacagcgacaccguggggugguccuggcccgacggcgcggagcugccguucaccaucgacaaguga

SEQ ID NO: 28123 - RNA, 1410 nt, Artificial Sequence; identical to SEQ ID NO: 28112
  derived and/or modified CDS sequence (AUadapt) from InfluenzaA__AIL94968__NA

SEQ ID NO: 28124 - RNA, 1410 nt, Artificial Sequence
  derived and/or modified CDS sequence (AUadapt) from InfluenzaA__AIM55840__NA
augaaccccaaccagaagaucaucaccaucggcucggugugcaugaccaucgggauggccaaccugauccuccagaucggcaacaucaucuccaucuggaucagccacuccauccaggucgggaaccagagccagaucgagaucugcaaccaguccgugaucacguacgagaacaacaccugggugaaccagaccuacgucaacaucagcaacaccaacuucgccgcgggccagccggugguguccgucaagcuggccgggaacagcucccugugccccgugagcggcugggccaucuacuccaaggacaacagcgugcgcaucggcuccaagggggacgucuucgugauccgggagcccuucaucucgugcagcccccucgagugccgcacguucuuccugacccagggcgcccugcucaacgacaagcacagcaacgggaccaucaaggaccgguccccguaccgcacccugaugagcugccccaucggcgaggugcccucccccuacaacagccgguucgagagcgucgccugguccgcgagcgccugccacgacgggaucaacuggcugacgaucggcaucuccggcccggacucgggggccguggccgugcucaaguacaacggcaucaucaccgacaccaucaaguccuggcgcaacgacauccugcggacccaggagagcgagugcgcgugcgucaacggguccugcuucacgaucaugaccgacggccccagcgacggccaggccuccuacaagaucuuccgcaucgagaaggggaagaucgugaaguccguggagaugaacgcccccaacuaccacuucgaggagugcuccugcuaccccgacagcuccgagaucacgugcgucugccgggacaacuggcacggcagcaaccgcccguggguguccuucaaccagaaccuggaguaccagaucggguacaucugcagcggcaucuucggggacaacccccggcccaacgacaagaccggcuccugcggccccgugagcuccaacggggccaacggcgucaagggguucucguucaaguacggcaacgggguguggaucggccgcaccaagagcaucuccagccggaagggcuucgagaugaucugggacccgaacggguggaccggcaccgacaacaacuucuccaucaagcaggacaucguggggaucaacgaguggagcggcuacuccgggagcuucguccagcaccccgagcucaccggccuggacugcauccgccccugcuucuggguggagcugauccggggccgccccaaggagaacacgaucuggaccuccgggagcuccaucagcuucugcggcgucaacuccgacaccgugggguggagcuggccggacggcgccgagcuccccuucaccaucgacaaguga

SEQ ID NO: 28125 - RNA, 1410 nt, Artificial Sequence
  derived and/or modified CDS sequence (AUadapt) from InfluenzaA__AIM55851__NA
augaaccccaaccagaagaucaucaccaucggcucggugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugccggucaagcuggccgggaacucgucccucugccccgugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacucgaacgggaccaucaaggaccgguccccguaccgcacgcugaugagcugccccaucggcgaggugcccucccccuacaacagccgguucgagagcgucgccugguccgcgagcgccugccacgacgggaucaacuggcucaccaucggcaucuccggcccggacucgggggccguggccgugcugaaguacaacggcaucaucaccgacaccaucaaguccuggcgcaacaacauccugcggacgcaggagagcgagugcgcgugcgucaacggguccugcuucaccaucaugaccgacggccccagcgacggccaggccuccuacaagaucuuccgcaucgagaaggggcggaucgugaaguccguggagaugaacgcccccaacuaccacuacgaggagugcuccugcuaccccgacagcuccgagaucacgugcgucugccgcgacaacuggcacggcagcaaccggccguggguguccuucaaccagaaccucgaguaccagaucggguacaucugcucgggcguguucggggacaacccccgccccaacgacaagaccggcuccugcggccccgucagcuccaacggggccaacggcgugaagggguucagcuucaaguacggcaacgggguguggaucggccggaccaagagcaucuccagccgcaagggcuucgagaugaucugggacccgaacggguggaccggcaccgacaacaaguucuccaucaagcaggacaucgucgggaucaacgaguggucgggcuacuccgggagcuucgugcagcaccccgagcugacgggccuggacugcauccggcccugcuucugggucgagcucauccgcggccggcccgaggagaacaccaucuggaccuccgggagcuccaucagcuucugcggcgugaaguccgacaccgugggguggagcuggccggacggcgccgagcugcccuucacgaucgacaaguga

SEQ ID NO: 28126 - RNA, 1410 nt, Artificial Sequence
  derived and/or modified CDS sequence (AUadapt) from InfluenzaA__AIM55862__NA
augaaccccaaccagaagaucaucaccaucggcucggugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugccggucaagcuggccgggaacucgucccucugccccgugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacucgaacgggaccaucaaggaccgguccccguaccgcacgcugaugagcugccccaucggcgaggugcccucccccuacaacagccgguucgagagcgucgccugguccgcgagcgccugccacgacgggaucaacuggcucaccaucggcaucuccggcccggacucgggggccguggccgugcugaaguacaacggcaucaucaccgacaccaucaaguccuggcgcaacaacauccugcggacgcaggagagcgagugcgcgugcgucaacggguccugcuucaccaucaugaccgacggccccagcgacggccaggccuccuacaagaucuucaagaucgagaaggggaagaucgugaaguccguggagaugaacgcccccaacuaccacuacgaggagugcuccugcuaccccgacagcuccgagaucacgugcgucugccgcgacaacuggcacggcagcaaccggccguggguguccuucaaccagaaccucgaguaccagaucggguacaucugcucgggcguguucggggacaacccccgccccaacgacaagaccggcuccugcggccccgucagcuccaacggggccaacggcgugaagggguucagcuucaaguacggcaacgggguguggaucggccggaccaagagcaucuccagccgcaagggcuucgagaugaucugggacccgaacggguggaacggcaccgacaacaacuucuccaucaagcaggacaucgucgggaucaaggaguggucgggcuacuccgggagcuucgugcagcaccccgagcugaccggccuggacugcauccggcccugcuucugggucgagcucauccgcggccggcccgaggagaacacgaucuggaccuccgggagcuccaucagcuucugcggcgugaacuccgacaccgugggguggagcuggccggacggcgccgagcugcccuucaccaucgacaaguga

SEQ ID NO: 28127 - RNA, 1410 nt, Artificial Sequence
  derived and/or modified CDS sequence (AUadapt) from InfluenzaA__AIM55873__NA
augaaccccaaccagaagaucaucaccaucggcucggugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugccggucaagcuggccgggaacucgucccucugccccgugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacucgaacgggaccaucaaggaccgguccccguaccgcacgcugaugagcugccccaucggcgaggugcccucccccuacaacagccgguucgagagcgucgccugguccgcgagcgccugccacgacgggaucaacuggcucaccaucggcaucuccggcccggacucgggggccguggccgugcugaaguacaacggcaucaucaccgacaccaucaaguccuggcgcaacaacauccugcggacgcaggagagcgagugcgcgugcgucaacggguccugcuucaccaucaugaccgacggccccagcgacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgcccguggguguccuucaaccagaaccucgaguaccagaucggguacaucugcucgggcguguucggggacaacccccggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggacccgaacggguggaccggcaccgacaacaacuucuccaucaagcaggacaucgucgggaucaaggaguggucgggcuacuccgggagcuucgugcagcaccccgagcugacgggccuggacugcauccgccccugcuucugggucgagcucauccggggccgccccgaggagaacaccaucuggaccuccgggagcuccaucagcuucugcggcgugaacuccgacaccgugggguggagcuggccggacggcgccgagcugcccuucacgaucgacaaguga

SEQ ID NO: 28128 - RNA, 1410 nt, Artificial Sequence; identical to SEQ ID NO: 28127
  derived and/or modified CDS sequence (AUadapt) from InfluenzaA__AIM55884__NA

SEQ ID NO: 28129 - RNA, 1410 nt, Artificial Sequence; identical to SEQ ID NO: 28127
  derived and/or modified CDS sequence (AUadapt) from InfluenzaA__AIM55918__NA

SEQ ID NO: 28130 - RNA, 1410 nt, Artificial Sequence
  derived and/or modified CDS sequence (AUadapt) from InfluenzaA__AIM55929__NA
augaaccccaaccagaagaucaucaccaucggcucggugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugucggucaagcuggccgggaacuccagccucugcccgguguccggcugggccaucuacagcaaggacaacuccgugcgcaucggcagcaagggggacgucuucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaccggcgaggugcccagccccuacaacagccgguucgaguccgucgccuggagcgcguccgccugccacgacgggaucaacuggcucaccaucggcaucagcggccccgacuccggggccguggccgugcugaaguacaacggcaucaucaccgacacgaucaagucguggcgcaacaacauccugcggacccaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcguguucggggacaacccgcggcccaacgacaagaccggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcacggacaacaacuucucgaucaagcaggacaucgucgggaucaaggagugguccggcuacagcggguccuucgugcagcacccggagcugaccggccuggacugcauccgccccugcuucugggucgagcucauccggggccgccccgaggagaacaccaucuggaccagcggguccagcaucuccuucugcggcgugaacagcgacacgguggggugguccuggcccgacggcgccgagcugccguucaccaucgacaaguga

SEQ ID NO: 28131 - RNA, 1410 nt, Artificial Sequence
  derived and/or modified CDS sequence (AUadapt) from InfluenzaA__AIM55940__NA
augaaccccaaccagaagaucaucaccaucggcucggugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcuccacgaacuucgccgcgggccagagcguggugccggucaagcuggccgggaacuccucgcucugccccguguccggcugggccaucuacagcaaggacaacuccgugcgcaucggcagcaagggggacgucuucgugauccgggagcccuucaucuccugcagcccccuggagugccgcaccuucuuccugacccagggcgcccuccugaacgacaagcacuccaacgggaccaucaaggaccggagcccguaccgcacgcugauguccugccccaucggcgaggugcccagccccuacaacucgcgguucgaguccgucgccuggagcgcguccgccugccacgacgggaucaacuggcucaccaucggcaucagcggcccggacuccggggccguggccgugcugaaguacaacggcaucaucaccgacaccaucaagagcuggcgcaacaacauccugcggacgcaggaguccgagugcgcgugcgucaacgggagcugcuucaccaucaugaccgacggccccuccgacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgcccgugggugagcuucaaccagaaccucgaguaccagaucggguacaucugcuccggcguguucggggacaacccccggcccaacgacaagaccggcagcugcggccccgucuccagcaacggggccaacggcgugaagggguucagcuucaaguacggcaacgggguguggaucggccgcaccaaguccaucucgucccggaagggcuucgagaugaucugggacccgaacggguggaccggcaccgacaacaacuucagcaucaagcaggacaucgucgggaucaaggagugguccggcuacagcggguccuucgugcagcaccccgagcugacgggccuggacugcauccgccccugcuucugggucgagcucauccggggccgccccgaggagaacaccaucuggaccagcggguccagcaucuccuucugcggcgugaacagcgacaccguggggugguccuggccggacggcgccgagcugcccuucacgaucgacaaguga

SEQ ID NO: 28132 - RNA, 1410 nt, Artificial Sequence
  derived and/or modified CDS sequence (AUadapt) from InfluenzaA__AIM55965__NA
augaaccccaaccagaagaucaucaccaucggcucggugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugccggucaagcuggccgggaacucgucccucugccccgugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacucgaacgggaccaucaaggaccgguccccguaccgcacgcugaugagcugccccaucggcgaggugcccucccccuacaacagccgguucgagagcgucgccugguccgcgagcgccugccacgacgggaucaacuggcucaccaucggcaucuccggcccggacucgggggccguggccgugcugaaguacaacggcaucaucaccgacaccaucaaguccuggcgcaacaacauccugcggacgcaggagagcgagugcgcgugcgucaacggguccugcuucaccaucaugaccgacggccccagcgacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgcccguggguguccuucaaccagaaccucgaguaccagaucggguacaucugcucgggcguguucggggacaacccccggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggacccgaacggguggaccggcaccgacaacaacuucuccaucaagcaggacaucgucgggaucaaggaguggucgggcuacuccgggagcuucgugcagcaccccgagcugacgggccuggacugcauccgccccugcuucugggucgagcucauccggggccgccccgaggagaacaccaucuggaccuccgggagcuccaucagcuucugcggcgugaacuccgacgccgugggguggagcuggccggacggcgcggagcugcccuucaccaucgacaaguga

SEQ ID NO: 28133 - RNA, 1410 nt, Artificial Sequence
  derived and/or modified CDS sequence (AUadapt) from InfluenzaA__AIM55976__NA
augaaccccaaccagaagaucaucaccaucggcucggugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccucgcucugcccgguguccggcugggccaucuacagcaaggacaacuccgugcgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacucgcgguucgaguccgucgccuggagcgcguccgccugccacgacgggaucaacuggcucaccaucggcaucagcggccccgacuccggggccguggccgugcugaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcguguucggggacaacccgcggcccaacgacaagaccggcagcugcggccccgucuccagcaacggggccaacggcgugaagggguucagcuucaaguacggcaacgggguguggaucggccgcaccaaguccaucucgucccggaagggcuucgagaugaucugggaccccaacggguggaccggcaccgacaacaacuucagcaucaagcaggacaucgucgggaucaaggagugguccggcuacagcggguccuucgugcagcacccggagcugacgggccuggacugcauccgccccugcuucugggucgagcucauccggggccgccccgaggagaacaccaucuggaccagcggguccagcaucuccuucugcggcgugaacagcgacaccguggggugguccuggcccgacggcgccgagcugccguucacgaucgacaaguga

SEQ ID NO: 28134 - RNA, 1410 nt, Artificial Sequence
  derived and/or modified CDS sequence (AUadapt) from InfluenzaA__AIM55987__NA
augaaccccaaccagaagaucaucaccaucggcucggugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugucggucaagcuggccgggaacuccagccucugcccgguguccggcugggccaucuacagcaaggacaacuccgugcgcaucggcagcaagggggacgucuucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaccggcgaggugcccagccccuacaacagccgguucgaguccgucgccuggagcgcguccgccugccacgacgggaucaacuggcucaccaucggcaucagcggccccgacuccggggccguggccgugcugaaguacaacggcaucaucaccgacacgaucaagucguggcgcaacaacauccugcggacccaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcguguucggggacaacccgcggcccaacgacaagaccggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcacggacaacaacuucucgaucaagcaggacaucgucgggaucaaggagugguccggcuacagcggguccuucgugcagcacccggagcugaccggccuggacugcauccgccccugcuucugggucgagcucauccggggccgccccgaggagaacaccaucuggaccagcggguccagcaucuccuucugcggcgugaacagcgacacgguggacugguccuggcccgacggggccgagcugccguucaccaucgacaaguga

SEQ ID NO: 28135 - RNA, 1410 nt, Artificial Sequence
  derived and/or modified CDS sequence (AUadapt) from InfluenzaA__AIM55998__NA
augaaccccaaccagaagaucaucaccaucggcucggugugcaugaccaucgggauggccaaccugauccuccagaucggcaacacgaucuccaucugggucagccacuccauccagcuggggaaccagagccagaucgagaccugcaaccaguccgugaucaccuacgagaacaacaccugggugaaccagacguacgucaacaucagcaacaccaacuucgccgcgggccaguccguggugccggucaagcuggccgggaacucgucccucugccccgugagcggcugggccaucuacuccaaggacaacagcgugcgcaucggcuccaagggggacgucuucgugauccgggagcccuucaucagcugcucgccccuggagugccgcaccuucuuccugacccagggcgcccuccugaacgacaagcacagcaacgggacgaucaaggaccgguccccguaccgcacccugaugagcugccccaucggcgaggugcccucccccuacaacagccgguucgagucggucgccugguccgcgagcgccugccacgacgggaucaacuggcucaccaucggcaucuccggcccggacagcggggccguggccgugcugaaguacaacggcaucaucaccgacacgaucaaguccuggcgcaacaacauccugcggacccaggagagcgagugcgcgugcgucaacggguccugcuucaccaucaugaccgacggccccucggacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgcccguggguguccuucaaccagaaccucgaguaccagaucggguacaucugcagcggcguguucggggacaacccccggcccaacgacaagaccggcuccugcggccccgucucguccaacggggccaacggcgugaagggguucagcuucaaguacggcaacgggguguggaucggccgcaccaagagcaucuccagccggaagggcuucgagaugaucugggacccgaacggguggaccggcacggacaacaaguucuccaucaagcaggacaucgucgggaucaacgaguggucgggcuacuccgggagcuucgugcagcaccccgagcugaccggccuggacugcauccgccccugcuucugggucgagcucauccggggccgccccgaggagaacaccaucuggaccuccgggagcuccaucagcuucugcggcgugaaguccgacacggugggguggagcuggccggacggcgccgagcugcccuucaccaucgacaaguga

SEQ ID NO: 28136 - RNA, 1410 nt, Artificial Sequence; identical to SEQ ID NO: 28133
  derived and/or modified CDS sequence (AUadapt) from InfluenzaA__AIM56009__NA

SEQ ID NO: 28137 - RNA, 1410 nt, Artificial Sequence; identical to SEQ ID NO: 28133
  derived and/or modified CDS sequence (AUadapt) from InfluenzaA__AIM56020__NA

SEQ ID NO: 28138 - RNA, 1410 nt, Artificial Sequence; identical to SEQ ID NO: 28133
  derived and/or modified CDS sequence (AUadapt) from InfluenzaA__AIM56031__NA

SEQ ID NO: 28139 - RNA, 1410 nt, Artificial Sequence
  derived and/or modified CDS sequence (AUadapt) from InfluenzaA__AIM56042__NA
augaaccccaaccagaagaucaucaccaucggcucggugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugccggucaagcuggccgggaacucgucccucugccccgugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacucgaacgggaccaucaaggaccgguccccguaccgcacgcugaugagcugccccaucggcgaggugcccucccccuacaacagccgguucgagagcgucgccugguccgcgagcgccugccacgacgggaucaacuggcucaccaucggcaucuccggcccggacucgggggccguggccgugcugaaguacaacggcaucaucaccgacaccaucaaguccuggcgcaacaacauccugcggacgcaggagagcgagugcgcgugcgucaacggguccugcuucaccaucaugaccgacggccccagcaacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgcccguggguguccuucaaccagaaccucgaguaccagaucggguacaucugcucgggcguguucggggacaacccccggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggacccgaacggguggaccggcaccgacaacaacuucuccaucaagcaggacaucgucgggaucaaggaguggucgggcuacuccgggagcuucgugcagcaccccgagcugacgggccuggacugcauccgccccugcuucugggucgagcucauccggggccgccccgaggagaacaccaucuggaccuccgggagcuccaucagcuucugcggcgugaacuccgacaccgugggguggagcuggccggacggcgccgagcugcccuucacgaucgacaaguga

SEQ ID NO: 28140 - RNA, 1410 nt, Artificial Sequence
  derived and/or modified CDS sequence (AUadapt) from InfluenzaA__AIM56053__NA
augaaccccaaccagaagaucaucaccaucggcucggugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccucgcucugcccgguguccggcugggccaucuacagcaaggacaacuccgugcgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacucgcgguucgaguccgucgccuggagcgcguccgccugccacgacgggaucaacuggcucaccaucggcaucagcggccccgacuccggggccguggccgugcugaaguacaacggcaucaucaccgacaccaucaagagcuggcgcaacaacauccugcggacgcaggaguccgagugcgcgugcgucaacgggagcugcuucaccaucaugaccgacggcccguccgacgagcaggccagcuacaagaucuuccgcaucgagaagggcaagaucgugaaguccguggagaugaacgcccccaacuaccacuacgaggagugcucgugcuaccccgacuccagcgagaucacgugcgucugccgggacaacuggcacggguccaaccgccccugggugagcuucaaccagaaccucgaguaccagaucggcuacaucugcuccgggguguucggcgacaacccgcggcccaacgacaagaccgggagcugcggccccgucuccagcaacggcgccaacggggugaagggcuucagcuucaaguacgggaacggcguguggaucgggcgcaccaaguccaucucgucccggaagggcuucgagaugaucugggaccccaacggcuggaccgggaccgacaacaacuucagcaucaagcaggacaucgucggcaucaaggagugguccggguacagcggcuccuucgugcagcacccggagcugacggggcuggacugcauccgccccugcuucugggucgagcucauccggggccgccccgaggagaacaccaucuggaccagcggcuccagcaucuccuucugcggggugaacagcgacaccgugggcugguccuggcccgacggggccgagcugccguucacgaucgacaaguga

SEQ ID NO: 28141 - RNA, 1410 nt, Artificial Sequence
  derived and/or modified CDS sequence (AUadapt) from InfluenzaA__AIM56064__NA
augaaccccaaccagaagaucaucaccaucggcucggugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugccggucaagcuggccgggaacucgucccucugccccgugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacucgaacgggaccaucaaggaccgguccccguaccgcacgcugaugagcugccccaucggcgaggugcccucccccuacaacagccgguucgagagcgucgccugguccgcgagcgccugccacgacgggaucaacuggcucaccaucggcaucuccggcccggacucgggggccguggccgugcugaaguacaacggcaucaucaccgacaccaucaaguccuggcgcaacaacauccugcggacgcaggagagcgagugcgcgugcgucaacggguccugcuucaccaucaugaccgacggccccagcgacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgcccguggguguccuucaaccagaaccucgaguaccagaucggguacaucugcucgggcguguucggggacaacccccggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggacccgaacggguggaccggcaccgacaacaacuucuccaucaagcaggacaucgucgggaucaaggaguggucgggcuacuccgggagcuucgugcagcaccccgagcugacgggccuggacugcauccgccccugcuucugggucgagcucgugcggggccgccccgaggagaacaccaucuggaccuccgggagcuccaucagcuucugcggcgugaacuccgacaccgucggguggagcuggccggacggcgccgagcugcccuucacgaucgacaaguga

SEQ ID NO: 28142 - RNA, 1410 nt, Artificial Sequence
  derived and/or modified CDS sequence (AUadapt) from InfluenzaA__AIM56086__NA
augaaccccaaccagaagaucaucaccaucggcucggugugcaugaccaucgggauggccaaccugauccuccagaucggcaacaucaucuccaucugggucagccacuccauccagcuggggaaccagagccacaucgagacgugcaaccaguccgugaucaccuacgagaacaacaccugggugaaccagaccuacgucaacaucagcaacacgaacuucgccgcgggccaguccguggugccggucaagcuggccgggaacucgucccucugccccgugagcggcugggccaucuacuccaaggacaacagcgugcgcaucggcuccaagggggacgucuucgugauccgggagcccuucaucagcugcucgccccuggagugccgcaccuucuuccugacccagggcgcccuccugaacgacaagcacuccaacgggaccaucaaggaccgguccccguaccgcacgcugaugagcugccccaucggcgaggugcccucccccuacaacagccgguucgagagcgucgccugguccgcgucggccugccacgacgggaucaacuggcucaccaucggcaucuccggcccggacaacggggccguggccgugcugaaguacaacggcaucaucaccgacaccaucaagagcuggcgcaacaacauccugcggacgcaggaguccgagugcgcgugcgucaacgggagcugcuucaccaucaugaccgacggccccuccgacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgcccgugggugagcuucaaccagaaccucgaguaccagaucggguacaucugcuccggcguguucggggacaacccccggcccaacgacaagaccggcagcugcggccccgucaccuccaacggggccaacggcgugaagggguucucguucaaguacggcaacgggguguggaucggccgcaccaaguccaucagcagccggaagggcuucgagaugaucugggacccgaacggguggaccggcacggacaacaacuucuccaucaagcaggacaucaucgggaucaaggaguggagcggcuacuccgggucguucguccagcaccccgagcugaccggccuggacugcauccgccccugcuucuggguggagcucauccggggccgccccgaggagaacaccaucuggaccuccgggagcuccaucagcuucugcggcgucaacuccgacacggugggguggagcuggccggacggcgccgagcugcccuucaccaucgacaaguga
